US009434770B2

(12) United States Patent
Das Gupta et al.

(10) Patent No.: US 9,434,770 B2
(45) Date of Patent: Sep. 6, 2016

(54) MODIFIED CUPREDOXIN DERIVED PEPTIDES

(76) Inventors: Tapas K Das Gupta, River Forest, IL (US); Craig W Beattie, Chicago, IL (US)

( * ) Notice: Subject to any disclaimer, the term of this patent is extended or adjusted under 35 U.S.C. 154(b) by 342 days.

(21) Appl. No.: 12/389,120

(22) Filed: Feb. 19, 2009

(65) Prior Publication Data

US 2009/0286719 A1 Nov. 19, 2009

Related U.S. Application Data

(63) Continuation-in-part of application No. 12/314,703, filed on Dec. 15, 2008, now abandoned, and a continuation-in-part of application No. 11/853,497, filed on Sep. 11, 2007, and a continuation-in-part of application No. 11/244,105, filed on Oct. 6, 2005, now Pat. No. 7,691,383.

(60) Provisional application No. 61/013,706, filed on Dec. 14, 2007, provisional application No. 60/843,388, filed on Sep. 11, 2006, provisional application No. 60/616,782, filed on Oct. 7, 2004, provisional application No. 60/680,500, filed on May 13, 2005, provisional application No. 60/700,297, filed on Jul. 19, 2005.

(51) Int. Cl.
*C07K 14/195* (2006.01)
*A61K 38/16* (2006.01)

(52) U.S. Cl.
CPC .......... *C07K 14/195* (2013.01); *A61K 38/164* (2013.01); *G01N 2333/16* (2013.01)

(58) Field of Classification Search
None
See application file for complete search history.

(56) References Cited

U.S. PATENT DOCUMENTS

| | | | |
|---|---|---|---|
| 6,551,795 B1 * | 4/2003 | Rubenfield et al. | 435/69.1 |
| 2002/0164703 A1 | 11/2002 | Pawlowski et al. | |
| 2004/0132966 A1 | 7/2004 | Miranda | |
| 2006/0040269 A1 | 2/2006 | Chakrabarty et al. | |
| 2006/0149037 A1 | 7/2006 | Chakrabarty et al. | |
| 2007/0054337 A1 | 3/2007 | Ferning et al. | |
| 2007/0161569 A1 | 7/2007 | Gardella | |
| 2008/0194697 A1 | 8/2008 | Frydman et al. | |
| 2008/0226560 A1 | 9/2008 | Das Gupta et al. | |
| 2008/0293619 A1 | 11/2008 | Chakrabarty et al. | |
| 2009/0042246 A1 | 2/2009 | Moll et al. | |

FOREIGN PATENT DOCUMENTS

| | | |
|---|---|---|
| WO | 0044888 | 8/2000 |
| WO | 03097085 A1 | 11/2003 |
| WO | 2005018662 A1 | 3/2005 |
| WO | WO2005018662 * | 3/2005 |
| WO | 2006088508 A2 | 8/2006 |
| WO | 2008033820 A2 | 3/2008 |
| WO | 2008033987 A2 | 3/2008 |
| WO | 2008098216 A2 | 8/2008 |

OTHER PUBLICATIONS

Fattorusso et al., Biopolyers (Peptide Science), 1995, 37:401-410.*
Hruby et al., Methods in Molecular Biology, vol. 35, Peptide Synthesis Protocols, 1994, Humana Press, Chapter 11.*
Jackson et al., J. Am. Chem. Soc., 1995, 117:819-820.*
Kuipers et al., Journal of Biological Chemistry, 2004, 279(21):22176-22182.*
Konduri et al., "Estrogen receptor abrogates transcriptional repression of p53 tumor suppressor protein," Proc. Amer. Assoc. Cancer Res. vol. 46, Abstract 3654, 2005.
Yamada et al., "Apoptosis or growth arrest: Modulation of tumor suppressor p52's specificity by bacterial redox protein azurin," PNAS, 101(14):4770-4775, Apr. 6, 2004.
Ye et al., "The construction of the eukaryotic expression plasmid pcDNA3.1/azurin and the increased apoptosis of U2OS cells transfected with it," Cell. Mol. Biol. Letters, 12(3):407-421, Abstract, 2007.
Lubelski, J. et al., Cell Mol. Life Sci. 65 pp. 455-476 (2007).
Rink, R. et al., Biochemistry 13; 46(45) pp. 13179-13189 (2007).
Rink, R. et al., Appl. Environ. Microbiol. 73(18) pp. 5809-5816 (2007).
Rink, R. et al., Appl. Environ. Microbiol. 73(6) pp. 1792-1796 (2007).
Li, B. et al., Science 10;311(5766) pp. 1464-1467 (2006).
Rink, R. et al., Biochemistry 21;44(24) pp. 8873-8882 (2005).
Zuhorn, Is. et al., Mol. Ther. 15(5) pp. 946-953 (2007).
Kim et al., Biochemistry 45(31):9434-44 (2006).
Ni et al., Cancer Letters 261:1-11 (2008).
Yamada et al., Natl. Acadamy of Sciences 99:22 14098-14103 (2002).
Chaudhari et al., Biochemistry, American Chemical Society 46:7 1799-1810 (2007).
Yamada et al., Cell Cycle 3:6 pp. 752-755 (2004).

(Continued)

*Primary Examiner* — Nicole Kinsey White
(74) *Attorney, Agent, or Firm* — Don J. Pelto, Esq.; Sheppard, Mullin, Richter & Hampton LLP

(57) ABSTRACT

The present invention provides modified cupredoxin derived peptides with pharmacologic activity that have improved pharmacokinetic properties, and methods to use them to treat mammals suffering from various conditions related to the pharmacologic activities. Modifications of the cupredoxin derived peptides include amino acid sequence variants and structural derivations that increase the plasma half-life of the peptide, increase the specific activity of the pharmacologic activity, decrease immunogenicity, and decrease the biotransformation of the peptides. The modified cupredoxin derived peptides can be used in methods to treat mammals for cancer, conditions related to inappropriate angiogenesis, viral and bacterial infections, and specifically HIV and malaria, conditions related to ephrin signaling, and to deliver cargo compounds, including diagnostic compounds, to cancer cells.

2 Claims, 65 Drawing Sheets

(56) References Cited

OTHER PUBLICATIONS

Punj, V. et al., Oncogene 23:13 2367-2378 (2004).

Database accession No. Q02F96 EBI accession No. UNIPROT:Q02F96 UniProt [Online] Nov. 14, 2006 "SubName: Full=Azurin:" (2006).

Yamada et al.: "Bacterial redox protein azurin, tumor suppressor protein p53, and regression of cancer," Proc. Natl. Acad. Sci., vol. 99, No. 22, pp. 14098-14103 (2002).

Punj et al.: "Bacterial cupredoxin azurin as an inducer of apoptosis and regression in human breast cancer," Oncogene, vol. 23, pp. 2367-2378 (2004).

* cited by examiner

SUBCUTANEOUS

AZURIN TRUNCATION WITH ALPHA-HELICAL STRUCTURE

RESULT OF 70 ns SIMULATION

MEASUREMENT OF THIOETHER BRIDGE POSITIONS BASED ON DISTANCES BETWEEN Cα ATOMS IN A STIMULATED STRUCTURE

| | Vmax | Km |
|---|---|---|
| MEL 2 | 1.87 | 159.1 |
| FIBROBLAST | 1.89 | 166.0 |

Vmax (MFI/sec), Km (μM)

| | Kd | Bmax | fmol/MILLION CELLS |
|---|---|---|---|
| p28 | 2.5 | 3.0 | 137 |
| AZURIN | 10 | 0.48 | 87.3 |

Kd (nM), Bmax (pM),

16 HOURS (4-1-2008)

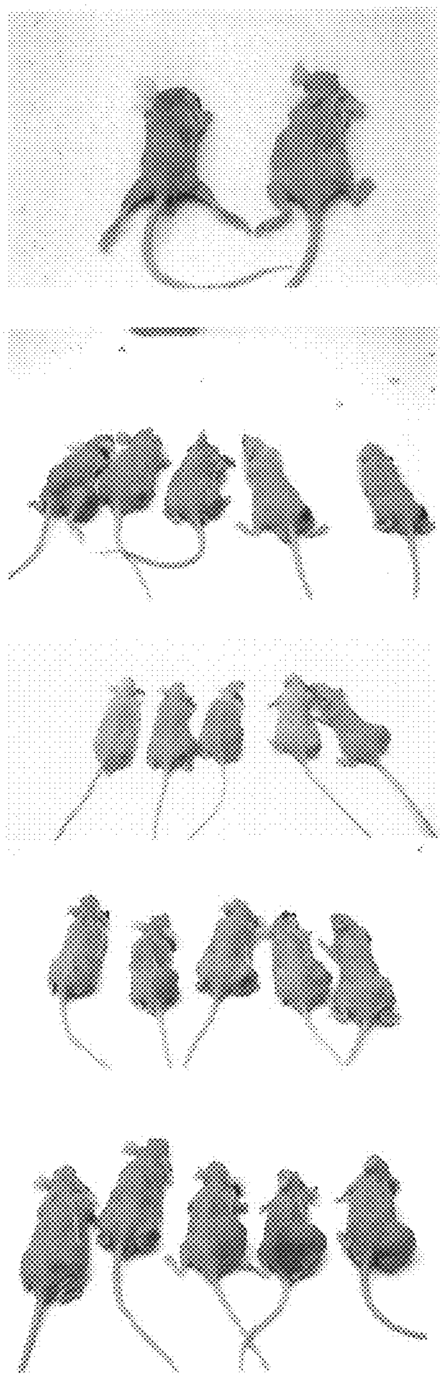
GROUP A DOXORUBICIN 3mg/kg IP
3 TREATMENTS
GROUP B 5mg/kg IP p28 DAILY
GROUP C PBS CONTROL
PBS IP DAILY
GROUP D 10mg/kg IP p28 DAILY
GROUP E 20mg/kg IP DAILY
FIG. 35A-E

MODIFIED CUPREDOXIN DERIVED PEPTIDES

CROSS REFERENCE TO RELATED APPLICATIONS

This application claims priority under 35 U.S.C. §§119 and 120 to, and is a continuation in part of U.S. patent application Ser. No. 12/314,703, filed on Dec. 15, 2008, which claims priority to U.S. Patent Application Ser. No. 61/013,709, filed on Dec. 14, 2007; and is a continuation in part of U.S. patent application Ser. No. 11/853,497, filed Sep. 11, 2007, which claims priority to Provisional U.S. Application Ser. No. 60/843,388, filed Sep. 11, 2006; and is a continuation in part of U.S. patent application Ser. No. 11/244,105, filed Oct. 6, 2005, issued as U.S. Pat. No. 7,691,383 on Apr.6, 2010, which claims priority to U.S. Provisional Patent Application Ser. No. 60/616,782, filed Oct. 7, 2004, U.S. Provisional Patent Application Ser. No. 60/680,500, filed May 13, 2005, and U.S. Provisional Patent Application Ser. No. 60/700,297, filed Jul. 19, 2005. The entire content of those applications are fully incorporated herein by reference.

FIELD OF THE INVENTION

The present invention relates to modified cupredoxin derived peptides with pharmacologic activity that have improved pharmacokinetic properties, and methods to use them to treat mammals suffering from various conditions related to the pharmacologic activities. Modifications of the cupredoxin derived peptides include amino acid sequence variants and structural derivations that may increase the plasma half-life of the peptide, increase the specific activity of the pharmacologic activity, decrease immunogenicity, and/or decrease the biotransformation of the peptides. The modified cupredoxin derived peptides can be used in methods to treat mammals for cancer, conditions related to inappropriate angiogenesis, viral and bacterial infections, and specifically HIV and malaria, conditions related to ephrin signaling and deliver cargo compounds, including diagnostic compounds, to cancer cells.

BACKGROUND

The cupredoxin azurin from *Pseudomonas aeruginosa* is a promising new therapeutic and diagnostic molecule. Two redox proteins elaborated by *P. aeruginosa*, the cupredoxin azurin and cytochrome $c_{551}$ (Cyt $c_{551}$), both enter J774 cells and show significant cytotoxic activity towards the human cancer cells as compared to normal cells. Zaborina et al., Microbiology 146: 2521-2530 (2000). Azurin can also enter human melanoma UISO-Mel-2 or human breast cancer MCF-7 cells. Yamada et al., PNAS 99:14098-14103 (2002); Punj et al., Oncogene 23:2367-2378 (2004); Yamada et al., Cell. Biol. 7:1418-1431 (2005). In addition, azurin from *P. aeruginosa* preferentially enters J774 murine reticulum cell sarcoma cells, forms a complex with and stabilizes the tumor suppressor protein p53, enhances the intracellular concentration of p53, and induces apoptosis. Yamada et al., Infection and Immunity, 70:7054-7062 (2002). Azurin also caused a significant increase of apoptosis in human osteosarcoma cells as compared to non-cancerous cells. Ye et al., Ai Zheng 24:298-304 (2003). Rusticyanin from *Thiobacillus ferrooxidans* can also enter macrophages and induce apoptosis. Yamada et al., Cell Cycle 3:1182-1187 (2004); Yamada et al., Cell. Micro. 7:1418-1431 (2005). Plastocyanin from

*Phormidium laminosum* and pseudoazurin form *Achromobacter cycloclastes* also are cytotoxic towards macrophages. U.S. Pat. Pub. No. 20060040269, published Feb. 23, 2006. Detailed studies of various domains of the azurin molecule suggested that amino acids 50-77 (p28) (SEQ ID NO: 13) represented a putative protein transduction domain (PTD) critical for internalization and subsequent apoptotic activity. Yamada et al., Cell. Microbial. 7:1418-1431 (2005), although possible routes of cellular entry were not identified Azurin is now also known to have other pharmacologic activities of therapeutic importance. It is known to inhibit angiogenesis in human umbilical vascular endothelium cells (HUVECs). U.S. patent application Ser. No. 11/488,693, filed Jul. 19, 2006. Azurin from *P. aeruginosa* is also known for its ability to inhibit the growth of HIV-1 infection in peripheral blood mononuclear cells and to inhibit parasitemia of malaria-infected mammalian red blood cells. Chaudhari et al., Cell Cycle. 5: 1642-1648 (2006). Azurin from *P. aeruginosa* is also known to interfere with the ephrin signaling system in various mammalian cells and tissues. U.S. patent application Ser. No. 11/436,592, filed May 19, 2006.

Azurin, and in particular, two peptides derived from azurin, an 18-mer and a 28-mer, have therefore been found to be useful therapeutically and diagnostically. However, the efficacy of a therapeutic agent in body of the patient is dependent on several factors. In addition to the activity of the therapeutic drug itself, there are also the pharmacokinetic properties of the therapeutic drug, and how it relates to the various processes that take place after the drug is administered, i.e., absorption, distribution, metabolism and excretion. These pharmacokinetic properties of the drug describe how and to what extent these biological processes influence the efficacy of the administered drug, and these properties include the drug half-life in the blood stream, the hepatic first-pass metabolism of the drug, the volume distribution of the drug, the degree of albumin binding of the drug, etc. Each of these pharmacokinetic properties can have a profound effect on the efficacy of the drug.

The site of absorption of the drug into the bloodstream of the patient depends on the route of administration. For example, orally administered drugs may be absorbed more at one site of the alimentary tract than another site due to the chemical and physical nature of the drug. Absorption by parenteral administration, on the other hand, is not only faster than oral administration, but the blood levels of the drug are far more predictable because much less of the drug is lost, particularly in intravenous administration. The bioavailability is the fraction of the administered drug that reaches the systemic circulation.

The distribution of the drug from the bloodstream into the extracelluar fluid (interstitium) and/or cells of the tissues may be altered by various aspects of the drug. The distribution of the drug in the body may be expressed as the "volume distribution of the drug," which is a hypothetical volume of liquid into which the drug is disseminated. The structure of the drug may influence the drug distribution in that hydrophobic drugs more readily move across most biological membranes, and thus may be distributed within cells of the tissues. A drug may also be bound to blood proteins and its passage into surrounding tissues thus delayed. For example, when in the blood stream, naproxen is 99% bound to plasma proteins, penicillin G is 60% bound, amoxicillin only 20% bound and minoxidil is unbound. Howard C. Ansel et al., *Pharmaceutical Dosage Forms and Delivery Systems* 129 (Lippincott, Williams and Wilkins 1999). A bound drug is neither exposed to the body's detoxification processes, nor is it removed from the bloodstream by filtration through the renal glomeruli. The bound drug is referred to as the inactive portion while the unbound portion is considered the active portion. The bound portion of the drug serves as a reservoir of the drug that is then released into the bloodstream in an unbound active form when the level of free drug is no longer sufficient to ensure protein saturation. Therefore, a drug that is bound in the bloodstream will remain in the body for longer periods of time and will require a less frequent dosage.

The metabolism of the drug in the patient will also affect its efficacy. Many drugs undergo biotransformation before being excreted from the body. The biotransformation of a drug may result in a form of the drug that is more water soluble, ore ionized, less capable of binding proteins in the plasma and tissues, less able to penetrate cell membranes, and other aspects that make the drugs less pharmacologically active. The biotransformed drug may therefore be rendered less toxic and more readily excreted. There are four major ways by which drugs are biotransformed: oxidation, reduction, hydrolysis, and conjugation. Oxidation reactions are primarily catalyzed by oxidases bound to the endoplasmic reticulum within the liver cells. Reduction reactions are catalyzed by reductases primarily in the gut and liver. Hydrolytic breakdown is catalyzed by esterases primarily in the liver. Glucuronide conjugation, the most common pathway of biotransformation of a drug, occurs by a combination of the drug with glucuronic acid, forming an ionic form of the drug that is easily eliminated from the body. Christensen et al., J. Pharm. Pharmacol. 37:91-95 (1985). Other biotransformative processes that increase elimination include methylation and acylation.

Excretion of the drug from the body may occur by various routes. The kidney plays the dominant role of eliminating the drug in the urine. However, the drug can also be eliminated from the plasma through the liver. With drugs that are orally administered in particular, the liver may play an important role in determining the plasma half-life of the drug.

SUMMARY OF THE INVENTION

One aspect of the invention provides an isolated modified cupredoxin derived peptide that is a variant, truncation or derivative of a cupredoxin derived peptide. In some embodiments, the modification includes cyclization. In one embodiment the cyclization is enzymatic cyclization. In another embodiment the cyclization creates a thioether cyclization. In another embodiment the thioether cyclization is formed by the addition of cysteine residues to dehydroalanine and dehydrobutrine residues. In another embodiment the dehydroalanine and dehydrobutrine residues originate from dehydration of serine and threonine respectively. In another embodiment NisB dehydrates the serine and threonine.

In one embodiment, the isolated modified cupredoxin derived peptide has improved pharmacokinetic properties as compared to the unmodified cupredoxin derived peptide. The improved pharmacokinetic property may be one or more of the peptide (1) is less susceptible to biotransformation in the patient, (2) is excreted from the body of the patient at a slower rate, (3) has increased stability of its tertiary structure and (4) has longer plasma half-life.

Additionally, the isolated peptide may have at least one pharmacologic activity of a cupredoxin. Specific pharmacologic activities of interest include (1) entering a mammalian cancer cell, (2) not entering non-cancerous mammalian cells, (3) entering pre-malignant mammalian cells, (4) killing mammalian cancer cells, (5) killing pre-malignant mammalian cells, (6) inhibiting the growth of a mammalian cancer cell, (7) inhibiting HIV-1 infection, (8) inhibiting parasitemia of malaria-infected red blood cells, (9) interfering with ephrin signaling system and (10) inhibiting angiogenesis.

The modified cupredoxin derived peptide may be derived from a cupredoxin from *Pseudomonas aeruginosa, Phormidium laminosum, Ulva pertussis, Thiobacillus ferrooxidans, Achromobacter cycloclastes, Pseudomonas syringae, Neisseria meningitidis, Vibrio parahaemolyticus, Bordetella bronchiseptica, Bordetella pertussis, Chloroflexus aurantiacus* and *Neisseria gonorrhoeae*. The cupredoxin may be azurin, plastocyanin, rusticyanin, pseudoazurin, auracyanin stellacyanin, cucumber basic protein or azurin-like protein. In specific embodiments, the cupredoxin may be one of SEQ ID NOS: 1-12.

The isolated modified cupredoxin derived peptide may be a truncation of the cupredoxin. In specific embodiments, the peptide may be one of SEQ ID NOS: 13-47. On other specific embodiments, SEQ ID NOS: 1-12 are at least about 90% identical to the isolated peptide.

In some embodiments, the isolated modified cupredoxin derived peptide may be less susceptible to hydrolysis than the corresponding unmodified cupredoxin. Specifically, the isolated peptide may have one or more asparagine or serine residues in the sequence of the cupredoxin derived peptide that are replaced with another amino acid residue, specifically a glutamic acid or threonine residue.

In some embodiments, the isolated modified cupredoxin derived peptide is less susceptible to deamidation. In specific embodiments, one or more glycine residues of the cupredoxin derived peptide are replaced with another amino acid residue, specifically a threonine or alanine residue. In some embodiments, one or more of the glycine residues in the cupredoxin derived peptide that are equivalent to residues 58 or 63 of *Pseudomonas aeruginosa* azurin (SEQ ID NO: 1) may be replaced. In another specific embodiment, the isolated peptide may comprise SEQ ID NO: 30.

In some embodiments, the isolated modified cupredoxin derived peptide is less susceptible to oxidation. Specifically, the isolated peptide may have one or more methionine or cysteine residues of the cupredoxin derived peptide replaced with another amino acid residue, specifically a leucine or valine residue. In a specific embodiment, one or more methionine residues of the cupredoxin derived peptide that are equivalent to residues 56 or 64 of *Pseudomonas aeruginosa* azurin (SEQ ID NO: 1) is replaced. In another specific embodiment, the isolated peptide may comprise SEQ ID NO: 31 or SEQ ID NO: 32.

In some embodiments, the isolated modified cupredoxin derived peptide may be less susceptible to diketopiperazine and pyroglutamic acid formation. Specifically, the isolated peptide may have a glycine residue in positions 1, 2 or 3 from the N-terminus of the cupredoxin derived peptide replaced with another amino acid residue. Further, the isolated peptide may have a proline residue in position 3 from the N-terminus of the cupredoxin derived peptide that is replaced with another amino acid residue. Further, the isolated peptide may have an asparagine residue at the N-terminus of the cupredoxin derived peptide replaced with another amino acid residue.

In some embodiments, the isolated modified cupredoxin derived peptide may be less susceptible to racemization. Specifically, the isolated peptide may have one or more amino acid residues of the cupredoxin derived peptide replaced with the D-isomer of the amino acid residue. In one specific embodiment, all of the amino acid residues of the cupredoxin derived peptide are replaced with the D-isomers of the amino acid residues. In another specific embodiment, the isolated peptide comprises SEQ ID NO: 45.

In some embodiments, the isolated modified cupredoxin derived peptide may be less susceptible to degradation. Specifically, the N-terminus of the cupredoxin derived peptide may be acetylated. Further, the C-terminus of the cupredoxin derived peptide may be amidated. In one specific embodiment, the isolated peptide is SEQ ID NO: 33.

In some embodiments, the isolated modified cupredoxin derived peptide is modified to increase the stability of its tertiary structure. Specifically, the isolated peptide may be modified to increase the stability of a least one α-helix. In some embodiments, at least one glycine, proline, serine, aspartic acid, alanine, threonine, valine, glutamine, asparagine, cysteine, histidine, lysine, and arginine amino acid residue of the cupredoxin derived peptide is replaced with leucine, isoleucine, phenylalanine, glutamic acid, tyrosine, tryptophan or methionine. In a specific embodiment, the replaced residue of the cupredoxin derived peptide may be within equivalent residues to residues 53-56, 58-64 and 68-70 of *P. aeruginosa* azurin. In other specific embodiments, the glutamine at a residue equivalent to residue 57 of *P. aeruginosa* azurin may be replaced with a tryptophan residue, the threonine at a residue equivalent to residue 52 of *P. aeruginosa* azurin may be replaced with a tryptophan residue, the threonine at a residue equivalent to residue 61 of *P. aeruginosa* azurin may be replaced with a tryptophan residue, and/or the glycine at a residue equivalent to residue 63 of *P. aeruginosa* azurin is replaced with a tryptophan residue. In other specific embodiments, the isolated peptide comprises one of SEQ ID NOS: 34-44.

In other embodiments, the isolated peptide may have two or more lysine residues of the cupredoxin derived peptide substituted with ϵ-(3,5-dinitrobenzoyl)-lysine residues in an i(i+4) spacing. Specifically, the replaced residues of the cupredoxin derived peptide may be within residues equivalent to residues 53-56, 58-64 and 68-70 of *P. aeruginosa* azurin.

In other embodiments, the isolated peptide may have histidine-cysteine or histidine-histidine residue pairs substituted into the cupredoxin derived peptide at an i(i+4) spacing, and at least one of Cu, Zn, Cd and Ru. In a specific embodiment, the isolated peptide may have the replaced residues of the cupredoxin derived peptide within residues equivalent to residues 53-56, 58-64 and 68-70 of *P. aeruginosa* azurin.

In another embodiment, the isolated peptide may have one or more pairs of native amino acid residues in the cupredoxin derived peptide substituted with α,α-disubstituted non-natural amino acids with olefin-bearing tethers that correspond to the native amino acids. The isolated peptide may have the replaced residues of the cupredoxin derived peptide within residues equivalent to residues 53-56, 58-64 and 68-70 of *P. aeruginosa* azurin.

In some embodiments, the isolated modified cupredoxin derived peptide may have one or more PEG (polyethylene glycol) molecules covalently bonded to the cupredoxin derived peptide. Specifically, the isolated peptide may have one or more PEG molecules is covalently bonded to one or more cysteine residues of the cupredoxin derived peptide. In specific embodiments, the isolated peptide may have one or more PEG molecules are covalently bonded to one or more cysteine residues equivalent to one or more of residues 3, 6, and 112 of *Pseudomonas aeruginosa* azurin (SEQ ID NO: 1). In another embodiment, a cysteine residue may be substituted into the cupredoxin derived peptide and may be covalently bonded to a PEG molecule.

In another embodiment, the isolated peptide may have one or more PEG molecules covalently bonded to the cupredoxin derived peptide at a lysine, cysteine, histidine, arginine, aspartic acid, glutamic acid, serine, threonine, tyrosine, N-terminal amino group, or C-terminal carboxylic acid. In specific embodiments, the isolated peptide has one or more lysine residues or C-terminal carboxylic acids covalently bonded to a PEG molecule. In another embodiment, one or more lysine, cysteine, histidine, arginine, aspartic acid, glutamic acid, serine, threonine and tyrosine residues may be substituted into the cupredoxin derived peptide and may be covalently bonded to a PEG molecule.

In other embodiments, one or more PEG molecules may be covalently bonded to one or more amino groups of the cupredoxin derived peptide, or randomly covalently bonded to the cupredoxin derived peptide.

The average molecular weight of the PEG molecules per cupredoxin derived peptide may be about 200 to about 100,000 daltons. The cupredoxin derived peptide may be covalently bonded to one or more branched PEG molecules, specifically where the branched PEG molecule is about 50 kDa. The cupredoxin derived peptide may be covalently bonded to one or more linear PEG molecules, specifically where the linear PEG molecule is about 5 kDa.

Another aspect of the invention is a pharmaceutical composition which may comprise a modified cupredoxin derived peptide and a pharmaceutically acceptable carrier.

Another aspect of the invention is a method to treat conditions suffered by mammals which may comprise administering to the mammal a therapeutically effective amount of the modified cupredoxin derived peptides. In specific embodiments, the mammal is human.

Another aspect of the invention is an isolated peptide which comprises, or alternatively consists of, the amino acid sequence $X_1SX_2AADX_3X_4X_5VVX_6DX_7X_8ASGLDKDYLKPDX_9$ (SEQ ID NO:48); wherein $X_1$ is selected from the group consisting of L and acetylated-L; $X_2$ is selected from the group consisting of T and W; $X_3$ is selected from the group consisting of M, L and V; $X_4$ is selected from the group consisting of Q and W; $X_5$ is selected from the group consisting of G and A; $X_6$ is selected from the group consisting of T and W; $X_7$ is selected from the group consisting of G, T and W; $X_8$ is selected from the group consisting of M, L and V; and $X_9$ is selected from the group consisting of D and amidated-L.

Another aspect of the invention is an isolated peptide comprising, or alternatively consisting of, the amino acid sequence $X_1DPKLYDKDLGSAX_2X_3DX_4VVX_5X_6X_7DAAX_8SX_9$ (SEQ ID NO:49); wherein $X_1$ is selected from the group consisting of D and acetylated-D; $X_2$ is selected from the group consisting of M, L and V; $X_3$ is selected from the group consisting of G, T and W; $X_4$ is selected from the group consisting of T and W; $X_5$ is selected from the group consisting of G and A; $X_6$ is selected from the group consisting of Q and W; $X_7$ is selected from the group consisting of M, L and V; $X_8$ is selected from the group consisting of T and W; and $X_9$ is selected from the group consisting of L and amidated-L.

Another aspect of the invention is an isolated peptide comprising, or consisting of, the sequences of SEQ ID NOS: 50-3504, which are cupredoxin derived peptides modified using one or more of the techniques and methods disclosed herein.

BRIEF DESCRIPTION OF THE SEQUENCES

SEQ ID NO: 1 is the amino acid sequence of wt-azurin from *Pseudomonas aeruginosa.*

SEQ ID NO: 2 is the amino acid sequence of plastocyanin from *Phormidium laminosum.*

SEQ ID NO: 3 is the amino acid sequence of rusticyanin from *Thiobacillus ferrooxidans.*

SEQ ID NO: 4 is the amino acid sequence of pseudoazurin from *Achromobacter cycloclastes.*

SEQ ID NO: 5 is the amino acid sequence of azurin from *Pseudomonas syringae.*

SEQ ID NO: 6 is the amino acid sequence of Laz from *Neisseria gonorrhoeae.*

SEQ ID NO: 7 is the amino acid sequence of the Laz from *Neisseria meningitides.*

SEQ ID NO: 8 is the amino acid sequence of the azurin from *Vibrio parahaemolyticus.*

SEQ ID NO: 9 is the amino acid sequence of the azurin from *Bordetella bronchiseptica.*

SEQ ID NO: 10 is the amino acid sequence of the auracyanin A from *Chloroflexus aurantiacus*

SEQ ID NO: 11 is the amino acid sequence of the auracyanin B from *Chloroflexus aurantiacus.*

SEQ ID NO: 12 is the amino acid sequence of the azurin from *Bordetella pertussis.*

SEQ ID NO: 13 is the amino acid sequence of the 50-77 amino acid fragment of wt-azurin (p28) from *Pseudomonas aeruginosa.*

SEQ ID NO: 14 is the amino acid sequence of the 50-67 amino acid fragment of wt-azurin (p18) from *Pseudomonas aeruginosa.*

SEQ ID NO: 15 is the amino acid sequence of the 36-128 amino acid fragment of wt-azurin from *Pseudomonas aeruginosa.*

SEQ ID NO: 16 is the amino acid sequence of the 36-89 amino acid fragment of wt-azurin from *Pseudomonas aeruginosa.*

SEQ ID NO: 17 is the amino acid sequence of the 36-77 amino acid fragment of wt-azurin from *Pseudomonas aeruginosa.*

SEQ ID NO: 18 is the amino acid sequence of the 36-50 amino acid fragment of wt-azurin from *Pseudomonas aeruginosa.*

SEQ ID NO: 19 is the amino acid sequence of the 50-66 amino acid fragment of wt-azurin from *Pseudomonas aeruginosa.*

SEQ ID NO: 20 is the amino acid sequence of the 67-77 amino acid fragment of wt-azurin from *Pseudomonas aeruginosa.*

SEQ ID NO: 21 is the amino acid sequence of the 57-89 amino acid fragment of auracyanin B of *Chloroflexus aurantiacus.*

SEQ ID NO: 22 is the amino acid sequence of the 50-77 amino acid fragment of azurin from *Bordetella pertussis.*

SEQ ID NO: 23 is the amino acid sequence of the 89-115 amino acid fragment of the Laz protein from *Neisseria meningitidis.*

SEQ ID NO: 24 is the amino acid sequence of the 53-70 amino acid fragment of azurin from *Pseudomonas aeruginosa.*

SEQ ID NO: 25 is the amino acid sequence of the 53-64 amino acid fragment of azurin from *Pseudomonas aeruginosa.*

SEQ ID NO: 26 is the amino acid sequence of the 51-77 amino acid fragment from azurin from *Pseudomonas aeruginosa.*

SEQ ID NO: 27 is the amino acid sequence of the 51-77 amino acid fragment from azurin from *Pseudomonas syringae.*

SEQ ID NO: 28 is the amino acid sequence of the is the 52-78 amino acid fragment from azurin from *Vibrio parahaemolyticus.*

SEQ ID NO: 29 is the amino acid sequence of the 51-77 amino acid fragment from azurin from *Bordetella bronchiseptica.*

SEQ ID NO: 30 is an artificial sequence for a variant form of the 50-77 amino acid region of *Pseudomonas aeruginosa* azurin.

SEQ ID NO: 31 is an artificial sequence for a variant form of the 50-77 amino acid region of *Pseudomonas aeruginosa* azurin.

SEQ ID NO: 32 is an artificial sequence for a variant form of the 50-77 amino acid region of *Pseudomonas aeruginosa* azurin.

SEQ ID NO: 33 is an artificial sequence for a variant form of the 50-77 amino acid region of *Pseudomonas aeruginosa* azurin.

SEQ ID NO: 34 is an artificial sequence for a variant form of the 50-77 amino acid region of *Pseudomonas aeruginosa* azurin.

SEQ ID NO: 35 is an artificial sequence for a variant form of the 50-77 amino acid region of *Pseudomonas aeruginosa* azurin.

SEQ ID NO: 36 is an artificial sequence for a variant form of the 50-77 amino acid region of *Pseudomonas aeruginosa* azurin.

SEQ ID NO: 37 is an artificial sequence for a variant form of the 50-77 amino acid region of *Pseudomonas aeruginosa* azurin.

SEQ ID NO: 38 is an artificial sequence for a variant form of the 50-77 amino acid region of *Pseudomonas aeruginosa* azurin.

SEQ ID NO: 39 is an artificial sequence for a variant form of the 50-77 amino acid region of *Pseudomonas aeruginosa* azurin.

SEQ ID NO: 40 is an artificial sequence for a variant form of the 50-77 amino acid region of *Pseudomonas aeruginosa* azurin.

SEQ ID NO: 41 is an artificial sequence for a variant form of the 50-77 amino acid region of *Pseudomonas aeruginosa* azurin.

SEQ ID NO: 42 is an artificial sequence for a variant form of the 50-77 amino acid region of *Pseudomonas aeruginosa* azurin.

SEQ ID NO: 43 is an artificial sequence for a variant form of the 50-77 amino acid region of *Pseudomonas aeruginosa* azurin.

SEQ ID NO: 44 is an artificial sequence for a variant form of the 50-77 amino acid region of *Pseudomonas aeruginosa* azurin.

SEQ ID NO: 45 is an artificial sequence for a variant form of the 50-77 amino acid region of *Pseudomonas aeruginosa* azurin.

SEQ ID NO: 46 is a conserved amino acid sequence from azurins where D is aspartic acid, G is glycine, Y is tyrosine, K is lysine and X is any amino acid.

SEQ ID NO: 47 is a conserved amino acid sequence from azurins where D is aspartic acid, G is glycine, Y is tyrosine, K is lysine and X is any amino acid.

SEQ ID NO: 48 is an artificial sequence of modifications to azurin 50-77 of *Pseudomonas aeruginosa.*

SEQ ID NO: 49 is an artificial sequence of modifications to the D-isomer of azurin 50-77 of *Pseudomonas aeruginosa.*

SEQ ID NOS: 50-3504 are sequences for variant forms of the 50-77 amino acid region of *Pseudomonas aeruginosa* azurin.

SEQ ID NO: 3505 is the amino acid sequence of Pep42, a cyclic 13-mer oligopeptide.

SEQ ID NO: 3506 is the amino acid sequence of the 66-77 amino acid fragment (p12) of wt-azurin from *Pseudomonas aeruginosa.*

SEQ ID NO: 3507 is a sequence for a variant form of the 50-77 amino acid region of *Pseudomonas aeruginosa* azurin.

SEQ ID NO: 3508 is a sequence for a variant form of the 50-77 amino acid region of *Pseudomonas aeruginosa* azurin.

SEQ ID NO: 3509 is a sequence for a variant form of the 50-77 amino acid region of *Pseudomonas aeruginosa* azurin.

SEQ ID NO: 3510 is a sequence for a variant form of the 50-77 amino acid region of *Pseudomonas aeruginosa* azurin.

SEQ ID NO: 3511 is a sequence for a variant form of the 50-77 amino acid region of *Pseudomonas aeruginosa* azurin.

SEQ ID NO: 3512 is a sequence for a variant form of the 50-77 amino acid region of *Pseudomonas aeruginosa* azin.

SEQ ID NO: 3513 is a sequence for a variant form of the 50-77 amino acid region of *Pseudomonas aeruginosa* azurin.

SEQ ID NO: 3514 is a sequence for a variant form of the 50-77 amino acid region of *Pseudomonas aeruginosa* azurin.

SEQ ID NO: 3515 is a sequence for a variant form of the 50-77 amino acid region of *Pseudomonas aeruginosa* azurin.

SEQ ID NO: 3516 is a sequence for a variant form of the 50-77 amino acid region of *Pseudomonas aeruginosa* azurin.

SEQ ID NO: 3517 is a sequence for a variant form of the 50-77 amino acid region of *Pseudomonas aeruginosa* azurin.

SEQ ID NO: 3518 is a sequence for a variant form of the 50-77 amino acid region of *Pseudomonas aeruginosa* azurin.

SEQ ID NO: 3519 is a sequence for a variant form of the 50-77 amino acid region of *Pseudomonas aeruginosa* azurin.

SEQ ID NO: 3520 is a sequence for a variant form of the 50-77 amino acid region of *Pseudomonas aeruginosa* azurin.

SEQ ID NO: 3521 is a sequence for a variant form of the 50-77 amino acid region of *Pseudomonas aeruginosa* azurin.

SEQ ID NO: 3522 is a sequence for a variant form of the 50-77 amino acid region of *Pseudomonas aeruginosa* azurin.

SEQ ID NO: 3523 is a sequence for a variant form of the 50-77 amino acid region of *Pseudomonas aeruginosa* azurin.

SEQ ID NO: 3524 is a sequence for a variant form of the 50-77 amino acid region of *Pseudomonas aeruginosa* azurin.

SEQ ID NO: 3525 is a sequence for a variant form of the 50-77 amino acid region of *Pseudomonas aeruginosa* azurin.

SEQ ID NO: 3526 is the amino acid sequence of the 60-77 amino acid fragment (p18b) of wt-azurin from *Pseudomonas aeruginosa.*

SEQ ID NO: 3527 is the amino acid sequence of Arg-8.

BRIEF DESCRIPTION OF THE FIGURES

FIGS. 6A and 6B are photographs showing penetration of azurin derived peptides into cancer cell lines of diverse histogenesis and their normal counterparts. FIGS. 6A and 6B are photographs showing penetration of Alexafluor 568 labeled p28 (SEQ ID NO: 13) and p18 (SEQ ID NO: 14), respectively, after 2 hrs at 37° C. The cationic Arg-8 (SEQ ID NO: 3527) was used as a control. FIG. 6C are graphs depicting flow eytometric analysis of the penetration of Alexafluor 568 labeled p28 (SEQ ID NO: 13) or p18 (SEQ ID NO: 14) into the same cell lines after 2 hrs at 37° C. FIG. 6D are graphs depicting fold increase over fluorescence from normal cells. Similar observations of p28 (SEQ ID NO: 13) or p18 (SEQ ID NO: 14) entry into 4 melanoma cell lines show a several fold increase over fluorescence from normal cells.

Figure 1:
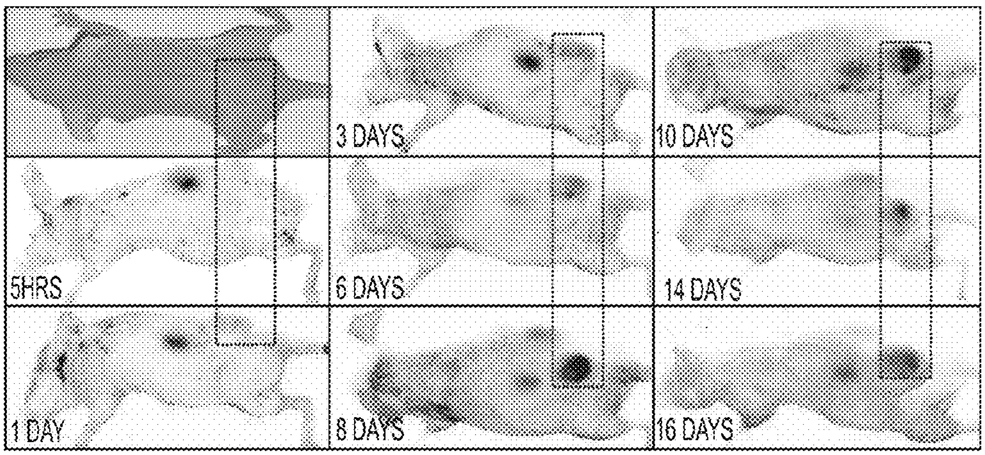
FIG. 1 depicts the images of whole mouse scans of mice that have been injected with labeled p18 (SEQ ID NO: 14). IRDye® labeled p18 (SEQ ID NO: 14) (125 μg) was injected intravenously and athymic mice were scanned at indicated time periods for detection of labeled dye in tumors and organs using the Odyssey® Infrared Imaging System.
Figure 2:
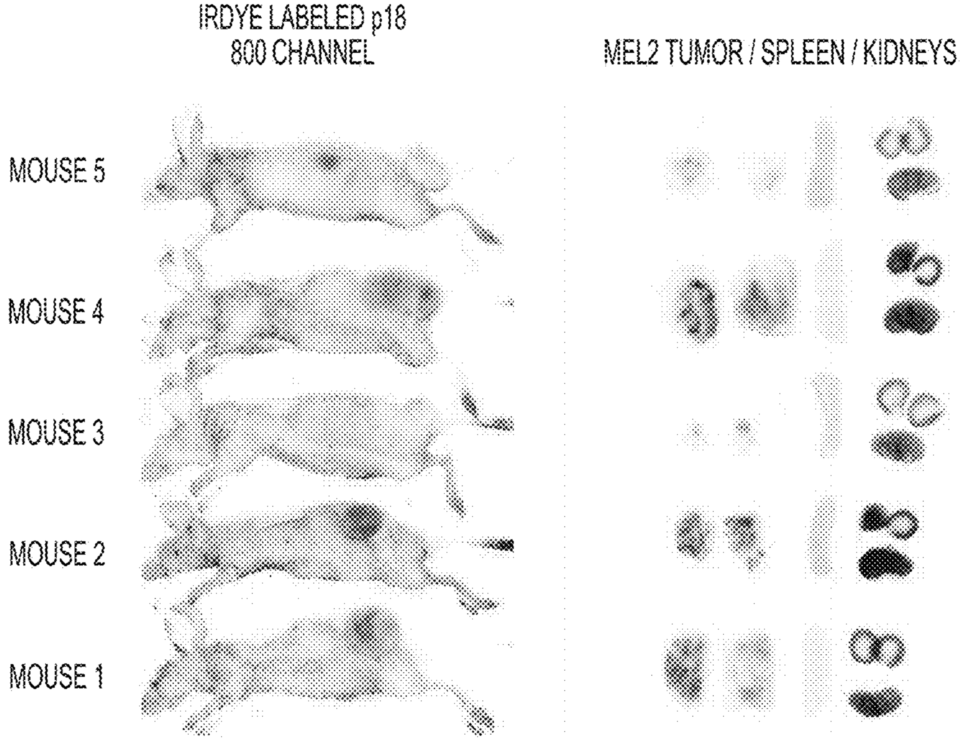
FIG. 2 depicts the images from whole mouse and organs scans of mice that have been injected with labeled p18 (SEQ ID NO: 14). 125 μg IRDye® labeled p18 (SEQ ID NO: 14) 120 h post-injection i.v. (immediately before sacrifice). Excised organs scanned and shown on right. p18 (SEQ ID NO: 14) signal was seen from kidneys and Mel-2 tumors.
Figure 3:
FIG. 3. Mel-2 subcutaneous tumor with 125 ug IRDye® labeled p18 (SEQ ID NO: 14) administered i.v. 3 weeks after Mel-2 cells were injected, and Odyssey® infrared scan was performed 48 hours later. Images recorded with the 800 nm channel represent specific p18 (SEQ ID NO: 14) signal from IRDye®, and those with the 700 nm channel represent background. p18 (SEQ ID NO: 14) signal was seen from kidneys and Mel-2 tumors.

Triton X-100 was defined as 100% hemoglobin release. Data represent mean±SEM of triplicate determinations.

FIG. 9 (A), (B), (C) and (D). Depicts photographs showing temperature dependent and competitive internalization of p28 (SEQ ID NO: 13) and p18 (SEQ ID NO: 14) into UISO-Mel-2 cells. Penetration of Alexafluor 568 labeled p28 (SEQ ID NO: 13) (A) or p18 (SEQ ID NO: 14) (B) at 2011 M was evaluated by confocal microscopy at different temperatures. (C) and (D) Confocal analysis of entry of Alexafluor 568 labeled p28 (SEQ ID NO: 13) (C) or p18 (SEQ ID NO: 14) (D) at 5 μM into UISO-Mel-2 cells after 30 min at 37° C. in the presence/absence of unlabeled peptide (200 fold excess).

FIG. 10 (A), (B), (C) and (D). (A) Depicts photographs showing confocal analysis of 28, p18 (SEQ ID NO: 14) (20 μM) and Arg-8 (SEQ ID NO: 3527) (10 μM) entry into UISO-Mel-2 cells after 1 hr at 37° C. in the presence/absence of heparin sulfate (100 μg/ml). (B) Graphs showing flow cytometric analysis of p28 (SEQ ID NO: 13) or p18 (SEQ ID NO: 14) entry in the presence of inhibitors. Cell fluorescence intensity in the absence of inhibitor (control) was considered as 100%. (C) Graphs depicting FRCS analysis of p28 (SEQ ID NO: 13) and p18 (SEQ ID NO: 14) entry into fibroblasts in presence of inhibitors. (D) Depicts photographs showing colocalization of p18 (SEQ ID NO: 14) and p28 (SEQ ID NO: 13) with caveolin I (Panel 1). UISO-Mel-2 cells were incubated with Alexafluor 568 labeled p18 (SEQ ID NO: 14) or p28 (SEQ ID NO: 13) (20 μM) or media for 2 hrs at 37° C. Cells were fixed and processed for anti-caveolin 1 immunostaining. Confocal analysis of entry of Alexafluor 568 labeled p18 (SEQ ID NO: 14) or p28 (SEQ ID NO: 13) (20 μM) into UISO-Mel-2 cells after 2 hrs at 37° C. followed by antigolgin 97 antibodies (Panel 2). Colocalization of Alexafluor 568 labeled azurin, p28 (SEQ ID NO: 13) and p18 (SEQ ID NO: 14) (red) with mitotracker (green) (Panel 3) and Lysotracker (green) (Panel 4) dyes in UISO-Mel-2 cells. Cells were incubated at 37° C. with 20 μM azurin, p28 (SEQ ID NO: 13), p18 (SEQ ID NO: 14) or media only. After 90 min incubation, mitotracker/lysotracker probes were added and cells incubated for 30 min. Cells were counterstained with DAPI (blue). Colocalization of azurin, p28 (SEQ ID NO: 13) or p18 (SEQ ID NO: 14) appears as a yellow florescence.

Figure 11A:
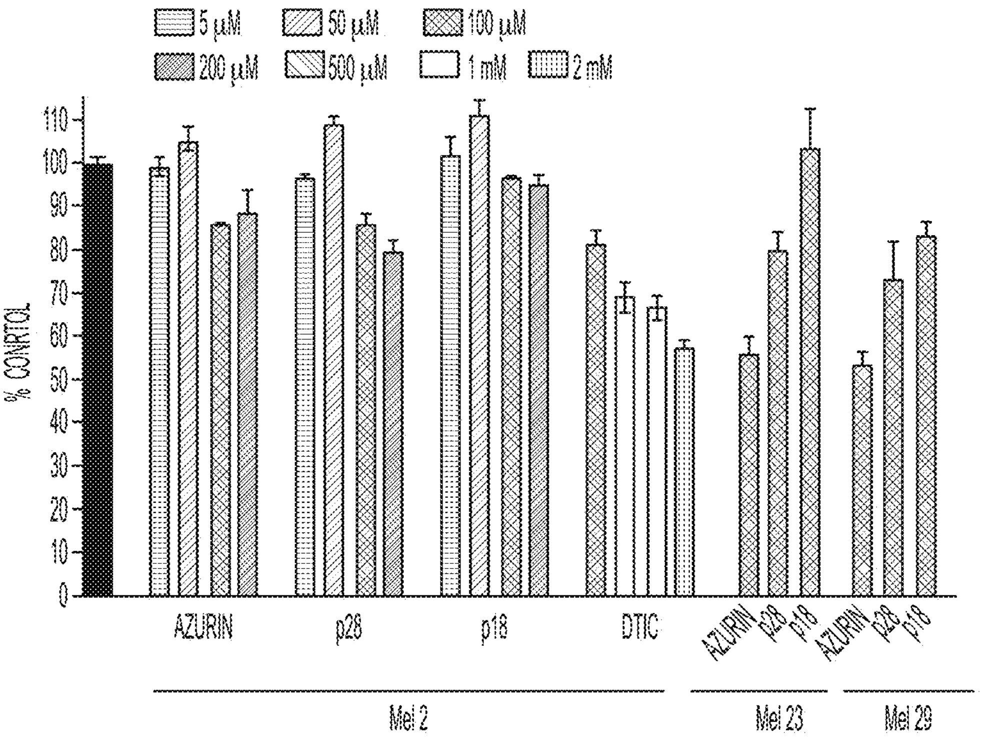
Figure 11B:
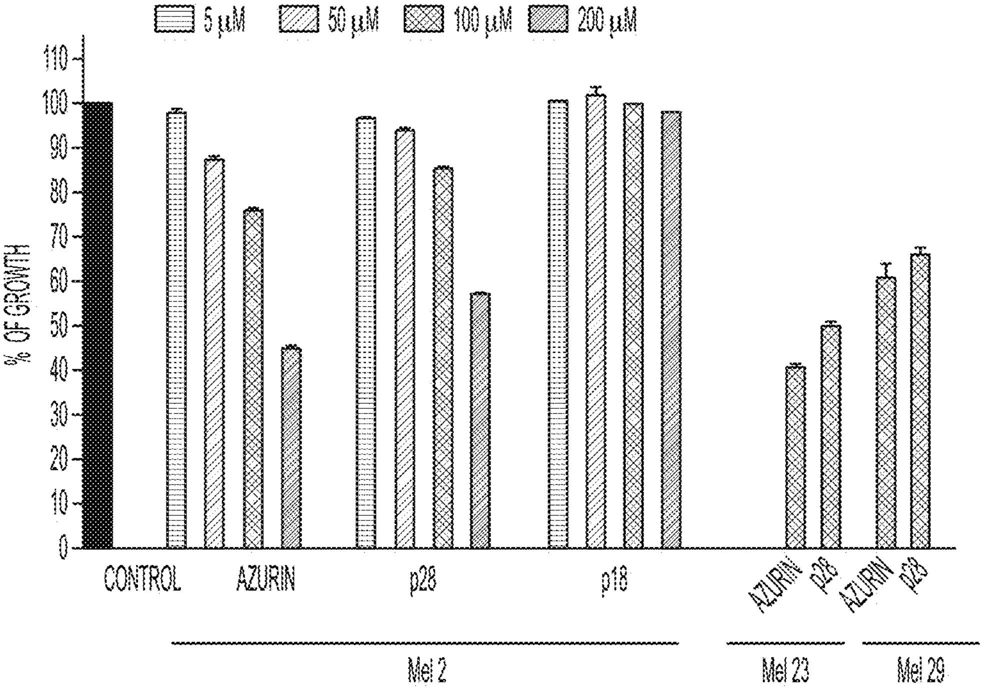
Figure 12A:
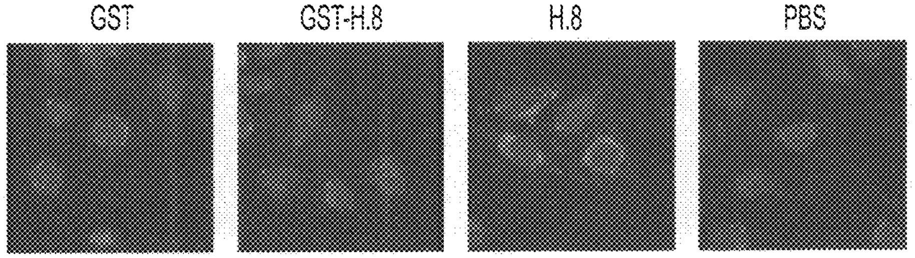
Figure 12B:
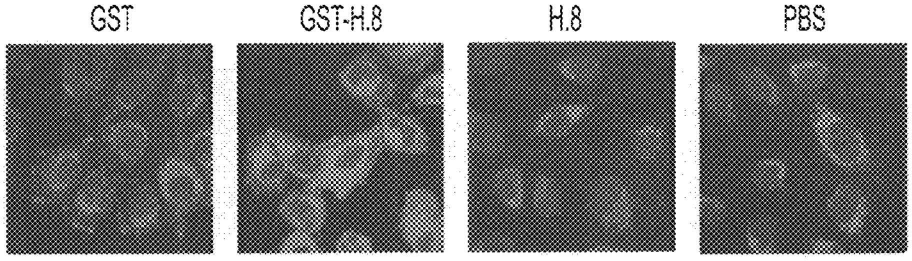
Figure 12C:
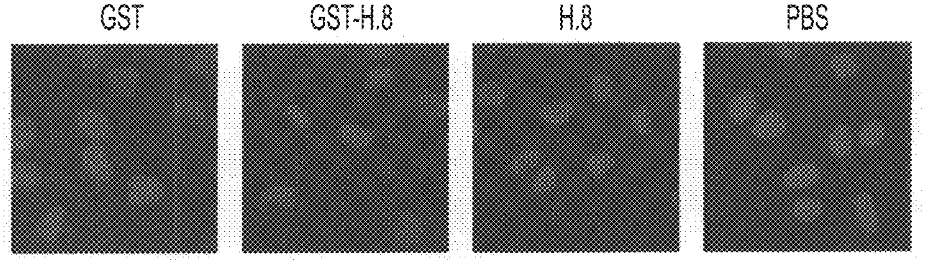
Figure 12D:
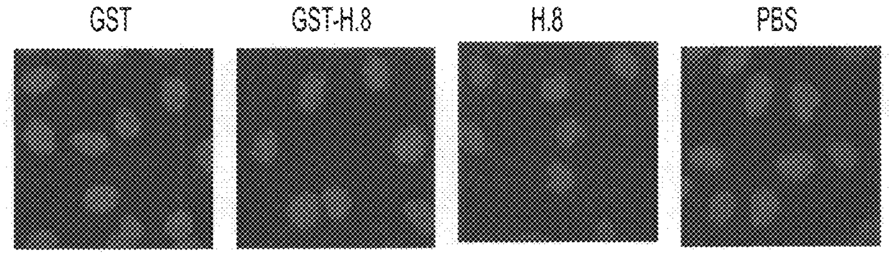
Figure 12E:
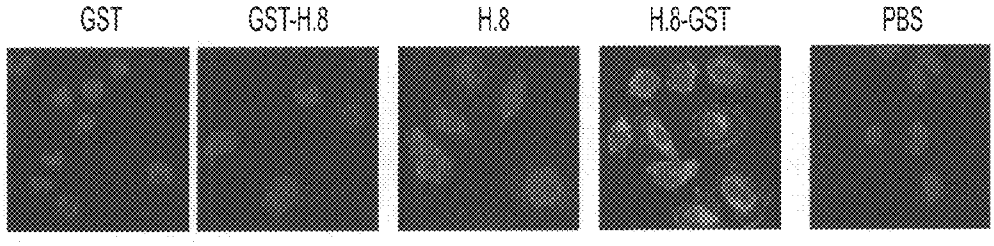
Figure 12F:
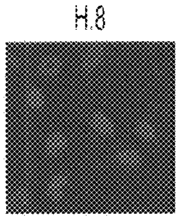
Figure 12G:
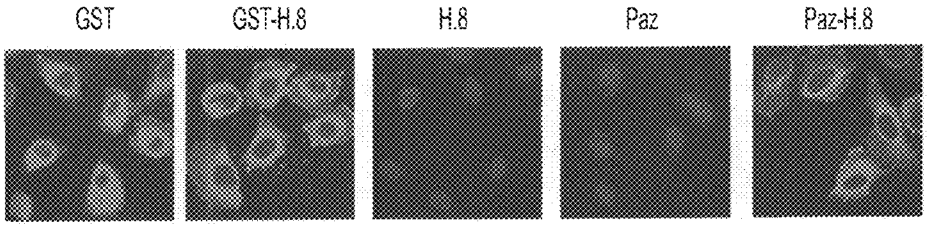
Figure 12H:
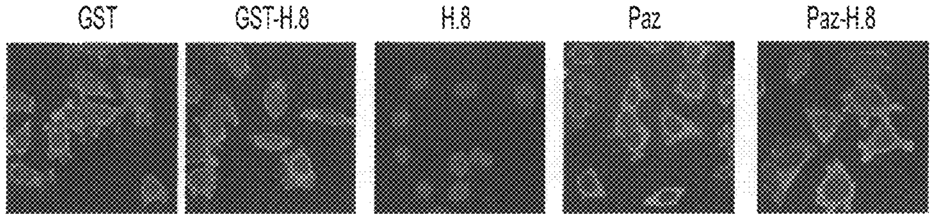

FIG. 11 (A) and (B). Graphs depicting UISO-Mel-2 cells that were incubated with increasing concentrations of azurin, p28 (SEQ ID NO: 13), or p18 (SEQ ID NO: 14) at 37° C. for 72 hrs. MTT (A); Direct cell count (B). Cell viability (MTT) or cell number in control wells were considered as 100%. Data represent mean±SEM.

FIG. 12, (A) through (H). Depict photographs showing uptake of compounds by cells, taken using a confocal microscope after treatment of cells with proteins and/or buffer. (A) Human brain tumor LN-229 cells were pretreated with 20 μM of unlabeled proteins or PBS buffer for 2 hours, then washed three times using PBS buffer. All buffer was discarded and then 20 μM of Alex568-Paz was added for 30 minutes at 37° C. (B) The IN-229 cells were then treated with 20 μM of unlabeled proteins or PBS buffer and 20 μM of Alex568-Paz for 30 minutes at 37° C. (C) Another group of human brain tumor LN-229 cells were pretreated with 10 μM unlabeled proteins or PBS buffer for 2 hours, then washed three times using PBS buffer. All buffer was discarded and then 10 μM of Alex568-Paz was added for 30 minutes at 37° C. (D) The LN-229 cells were then treated with 10 μM unlabeled proteins or PBS buffer and 10 μM of Alex568-Paz for 30 minutes at 37° C. (E) Human brain tumor LN-229 cells were treated with 20 μM of unlabeled proteins or PBS buffer and 20 μM of Alex568-Paz for 30 minutes at 37° C. (F) Human brain tumor LN-229 cells were treated with 20 μM of Alex568-H.8 for 30 minutes at 37° C. (G) Human brain tumor LN-229 cells were treated with 20 μM Alex568-proteins for 30 minutes at 37° C. (H) Human breast adenocarcinoma MCF-7 cells were treated with 20 μM of Alex568-proteins for 30 minutes at 37° C.

Figures 13A, 13B, 13C:
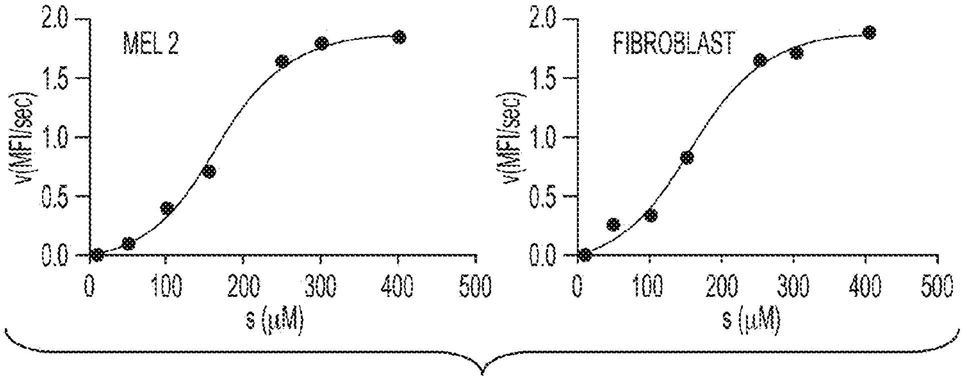

FIG. 13, (A) through (C). Graphs and charts depicting peptide binding and entry into cells. (A) UISO-Mel-2 or fibroblast cells ($3\times10^5$ cells) were suspended in MEME media without phenol red. Reactions were started by adding Alexafluor 568-conjugated p28 (SEQ ID NO: 13) at 10, 50, 100, 150, 250, 300 and 400 μM for 30, 60, 90 and 120 sec on ice. Cells were analyzed by flow cytometry. (B) The $K_m$ and $V_{max}$ were calculated by plotting peptide concentration (μM) vs. velocity (MFI/sec). (C) Peptide binding and entry was determined using whole Mel2 cells (50,000 cells/ml), were incubated for 30 min at 37° C. with increasing concentrations (0-175 nM) of radiolabeled azurin in the presence/absence of 1000 fold excess of unlabeled p28 (SEQ ID NO: 13), or azurin, and radioactivity remaining in the cell pellet counted using a gamma counter. Radioactivity in cells incubated with $^{125}I$ azurin alone was considered total binding; radioactivity in the presence of unlabeled azurin or p28 (SEQ ID NO: 13) was considered nonspecific binding. Specific binding was determined by subtracting nonspecific binding from total binding and Scatchard plots generated.

Figure 14A:
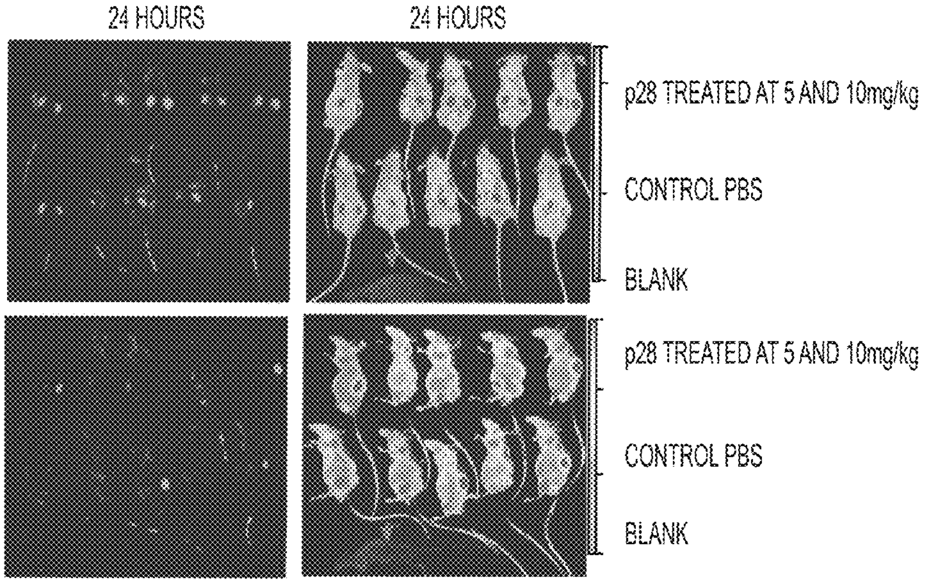
Figure 14B:
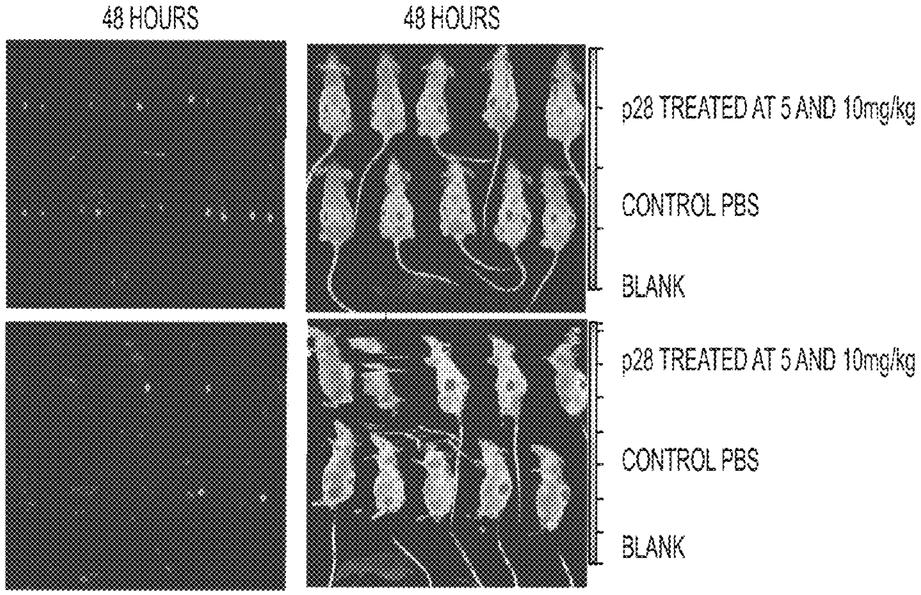
Figure 14C:
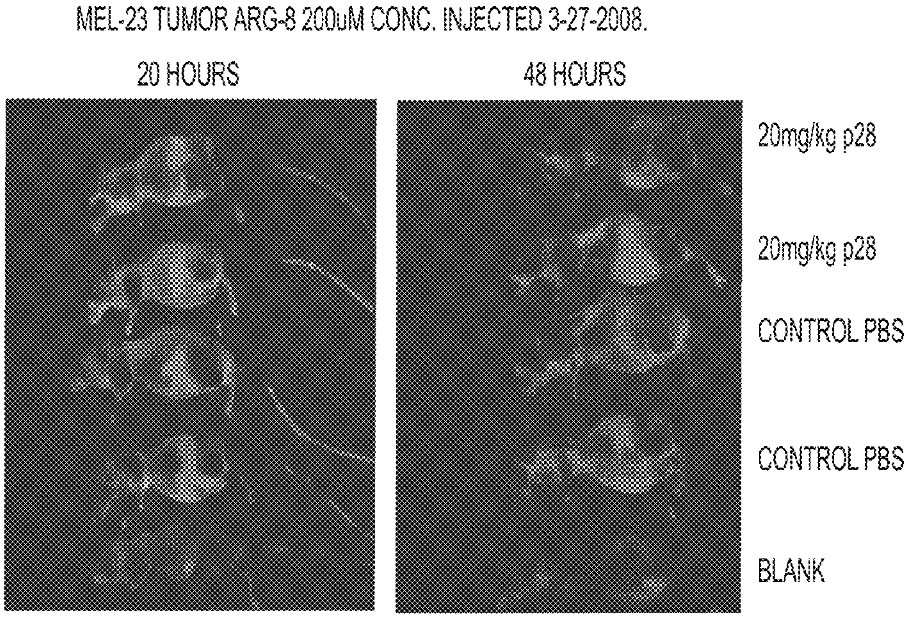

FIG. 14, (A) through (C). Depict side and back photographs of mice with melanoma MEL-23 tumors taken after injection with p28 (SEQ ID NO: 13) dye complex at 60 μmolar concentration in 250 μL scans and after injection with control PBS at (A) 24 hours and (B) 48 hours. (C) depicts side and back photographs of mice with melanoma MEL-23 tumors taken after injection with p28 (SEQ ID NO: 13) at 200 μM concentration at 24 and 48 hours.

Figure 15A:
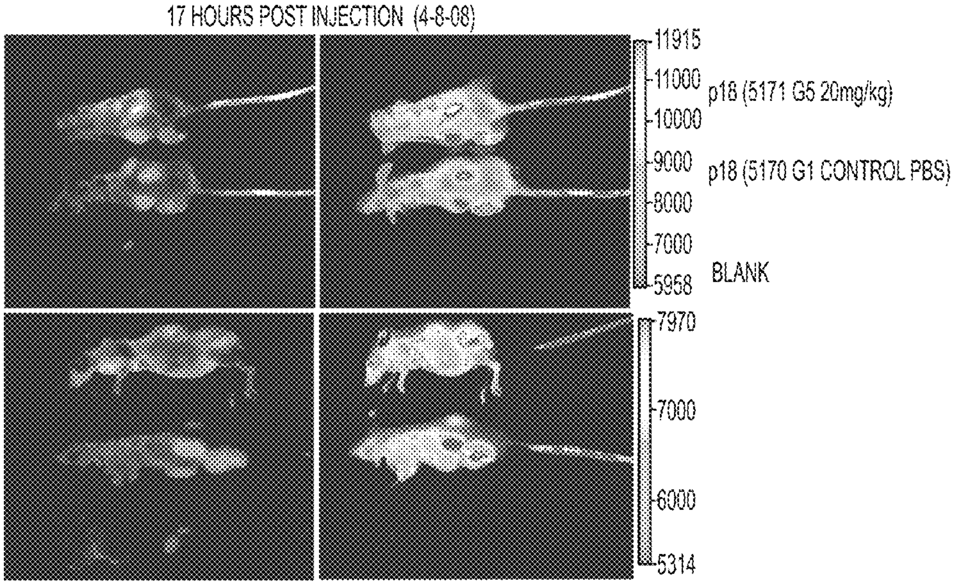
Figure 15B:
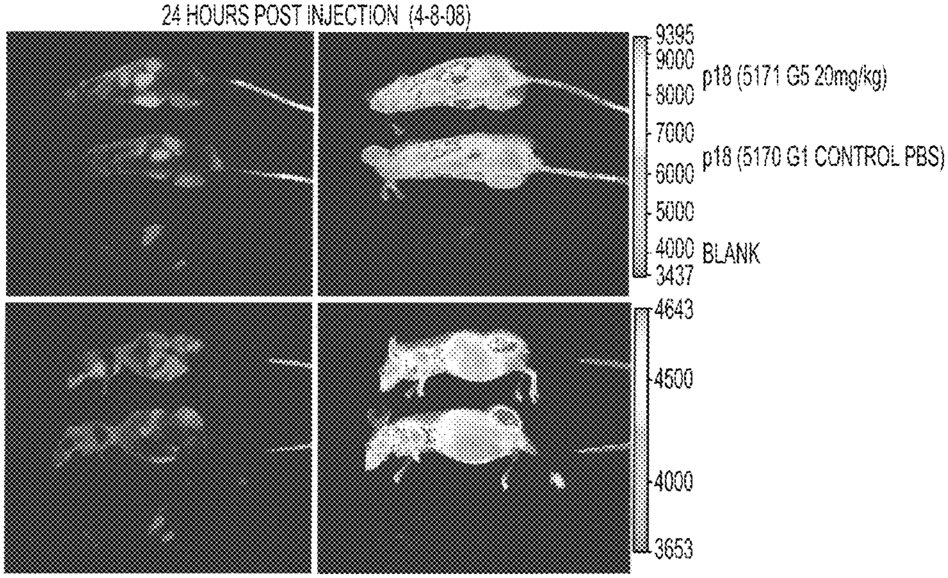
Figure 15C:
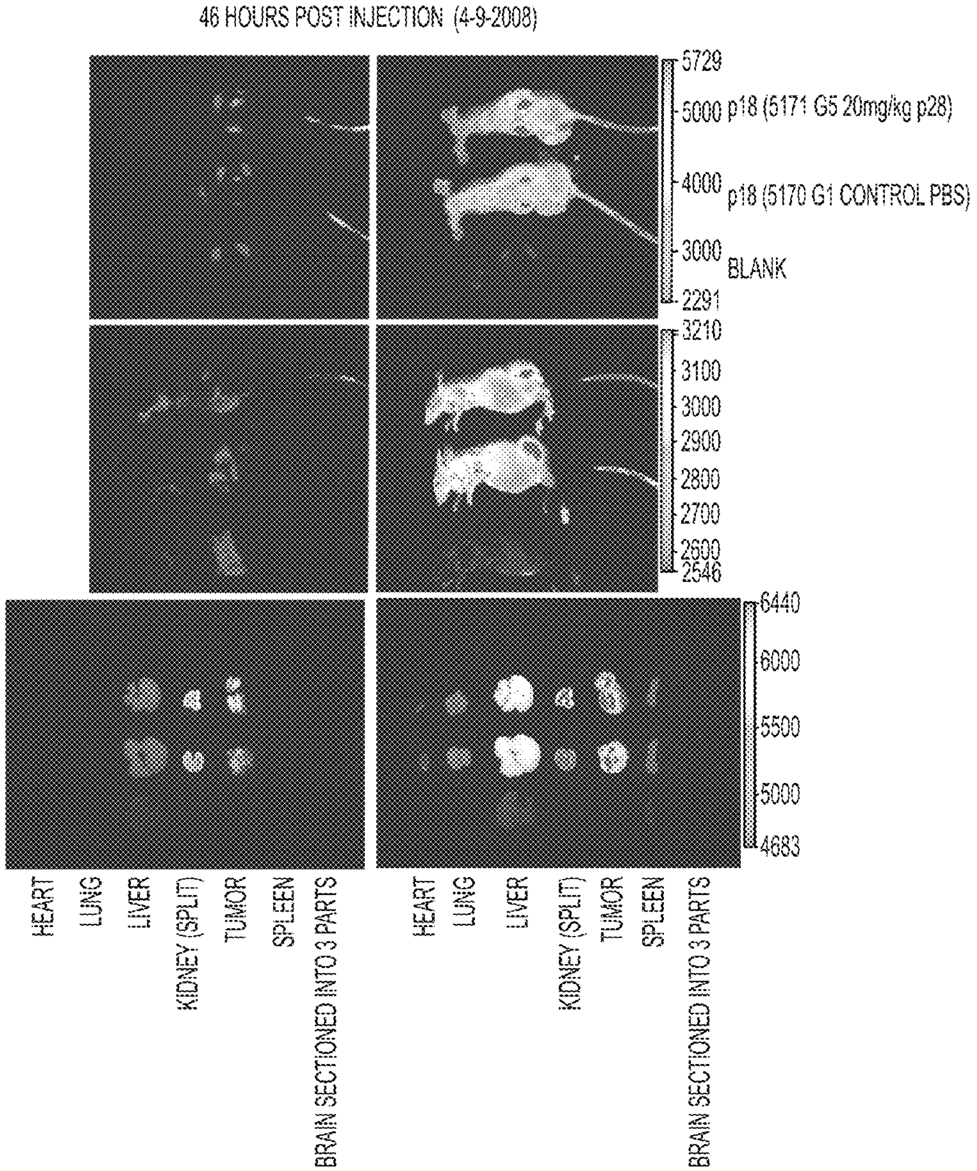

FIG. 15, (A) through (C). Depict side and back photographs of mice with melanoma MEL-23 tumors taken after injection with p18 (SEQ ID NO: 14) at 60 μmolar concentration at (A) 17 hours, (B) 24 hours, and (C) 46 hours. (C) also depicts photographs of mouse organs, including the heart, lung, liver, kidney, spleen, and brain, taken 46 hours after injection of p18 (SEQ ID NO: 14).

Figure 16A:
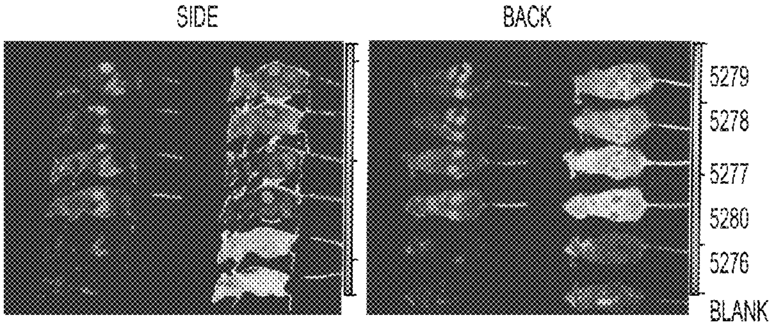
Figure 16B:
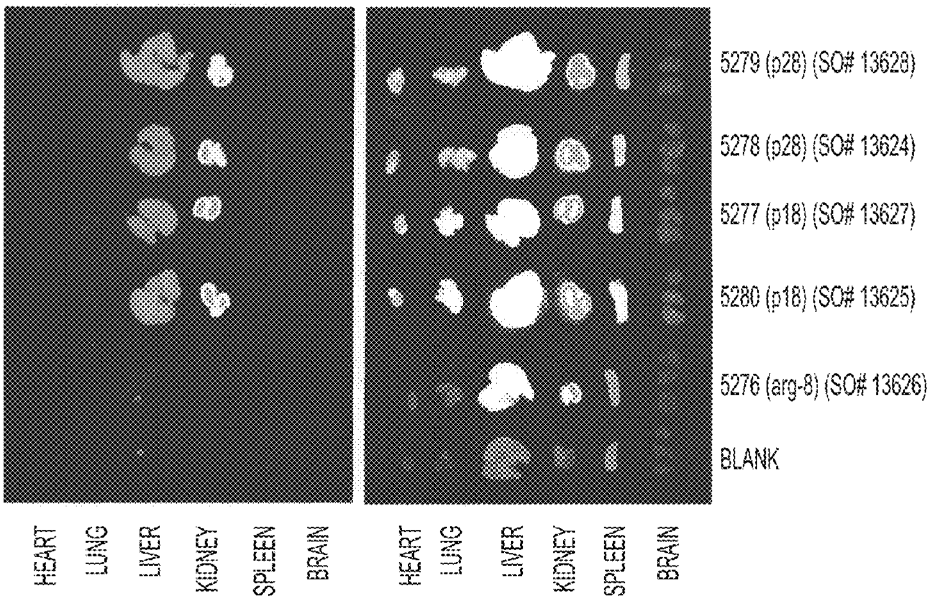

FIG. 16, (A) and (B). (A) Depicts side and back photographs of mice with tumors taken 12 hours after injection with p18 (SEQ ID NO: 14), p28 (SEQ ID NO: 13), and Arg-8 (SEQ ID NO: 3527) at 60 μmolar concentration. (B) Depicts photographs of mouse organs, including mouse brains, taken 12 hours after injection with p18 (SEQ ID NO: 14), p28 (SEQ ID NO: 13), and Arg-8 (SEQ ID NO: 3527).

Figure 17A:
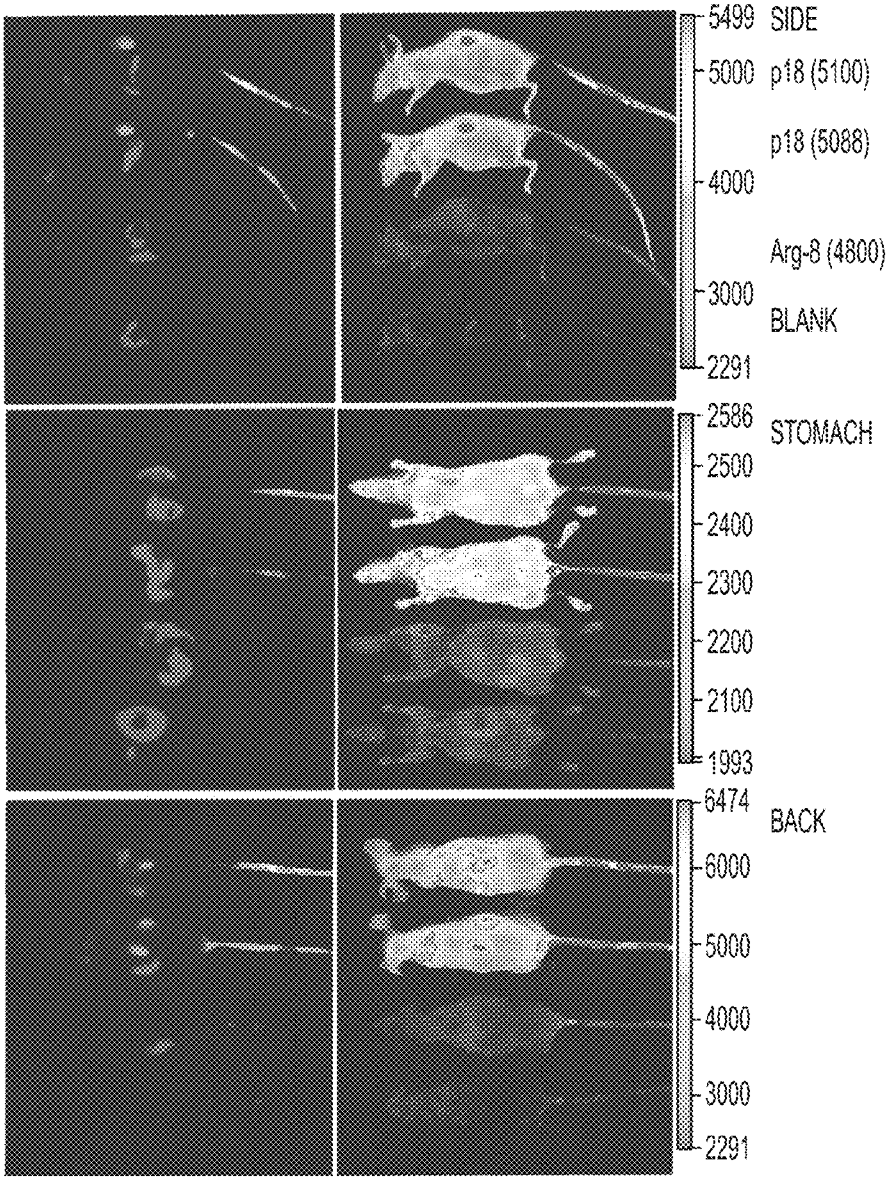
Figure 17B:
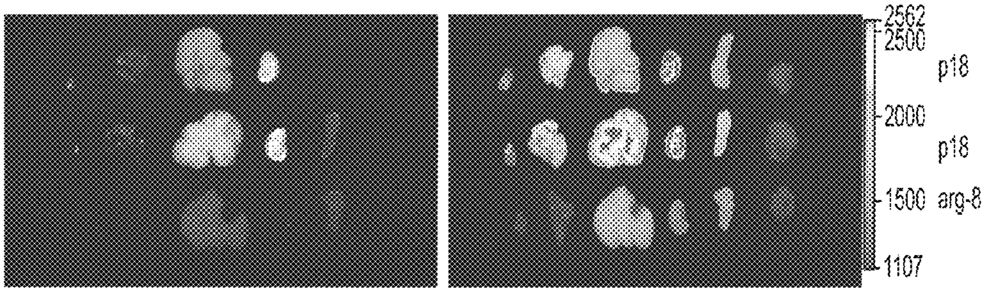

FIG. 17, (A) and (B). (A) Depicts side and back photographs of mice with melanoma MEL-6 tumors taken 40 hours after injections of 600 μM concentrations of p18 (SEQ ID NO: 14) and Arg-8 (SEQ ID NO: 3527) into tail veins. Animals treated with p18 (SEQ ID NO: 14) received 0.5 million cells, and animals treated with Arg-8 (SEQ ID NO: 3527) received 1 million cells. (B) Depicts photographs of mouse organs taken 40 hours after injections of 600 μM concentrations of p18 (SEQ ID NO: 14) and Arg-8 (SEQ ID NO: 3527).

Figure 18A:
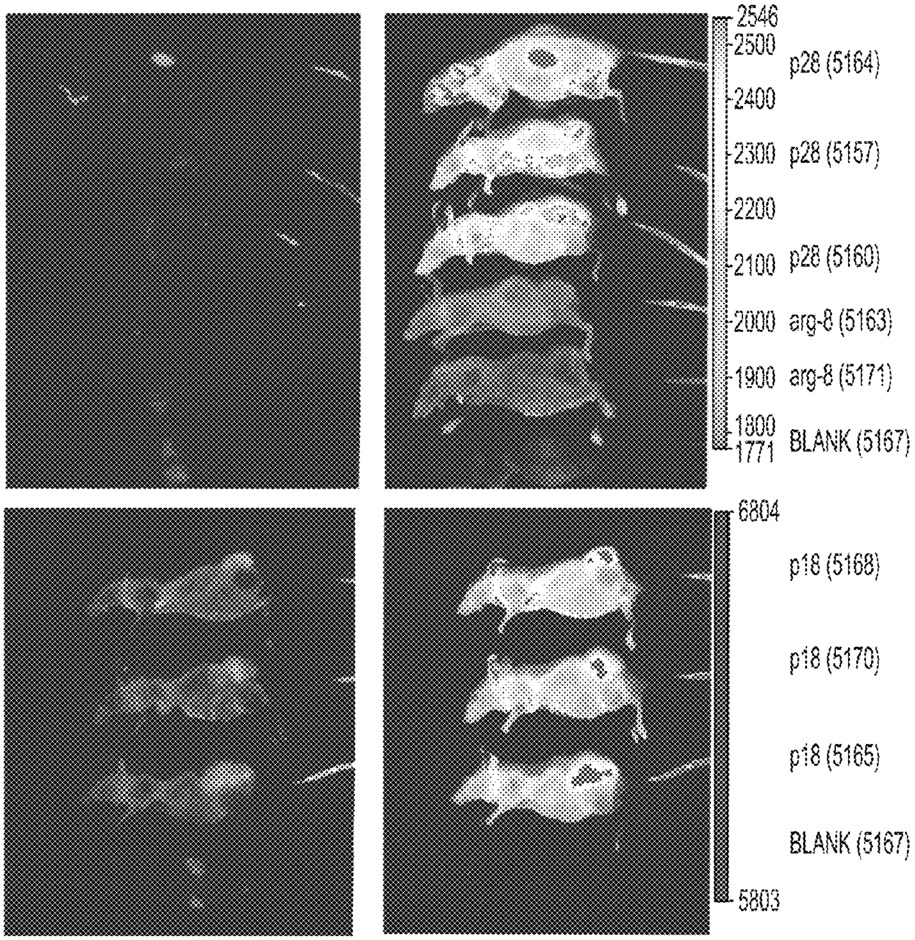
Figure 18B:
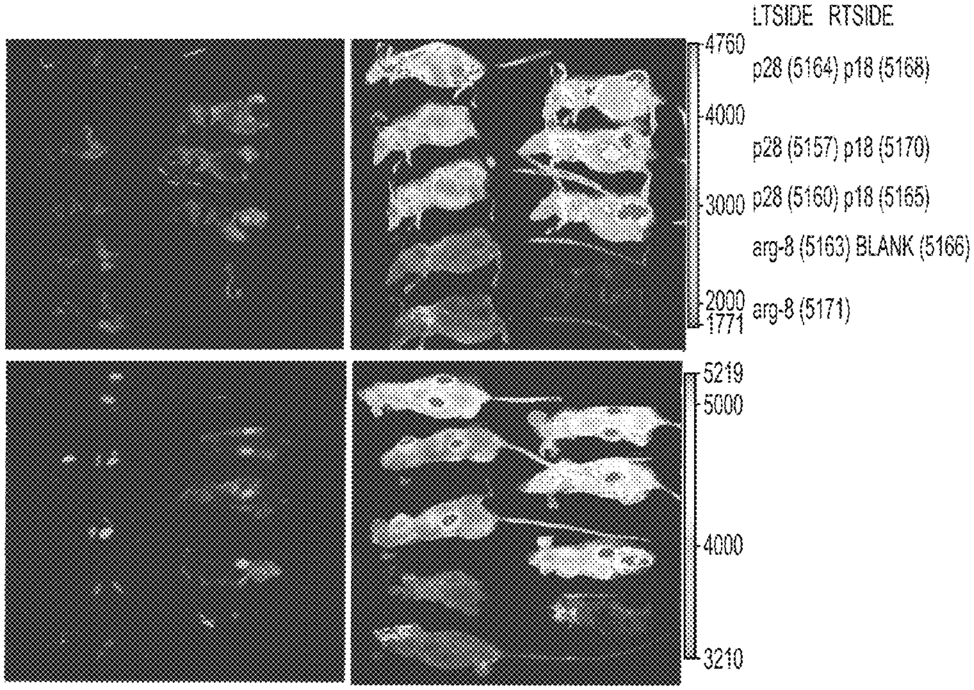

FIG. 18, (A) and (B). (A) Depicts side and back photographs of mice with melanoma MEL-23 tumors taken 16 hours after injections of 60 μM concentrations of p28 (SEQ ID NO: 13), p18 (SEQ ID NO: 14), and Arg-8 (SEQ ID NO: 3527). (B) Depicts side and back photographs of mice with melanoma MEL-23 tumors taken 24 hours after injections of 60 μM concentrations of p28 (SEQ ID NO: 13), p18 (SEQ ID NO: 14), and Arg-8 (SEQ ID NO: 3527).

Figure 19:
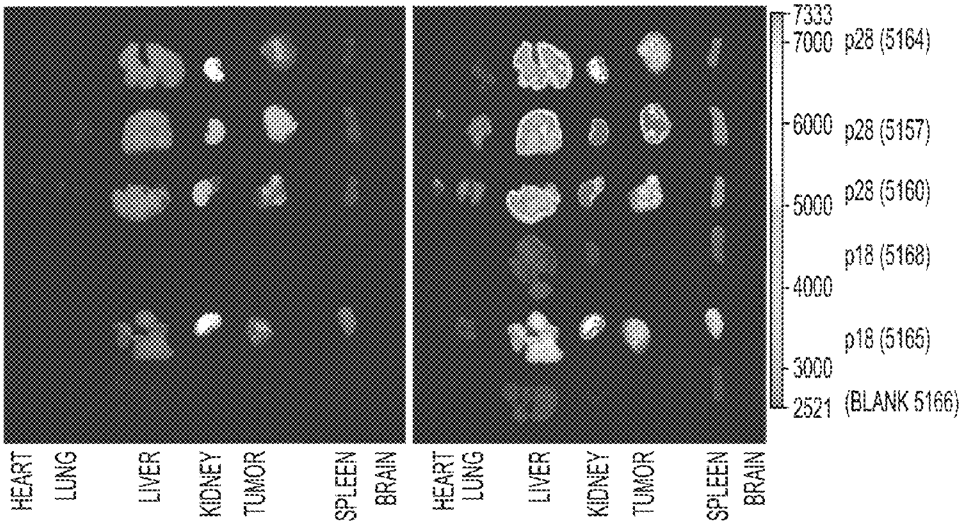

FIG. 19. Depicts photographs of mouse organs taken 48 hours after injection of 60 μM concentrations of p28 (SEQ ID NO: 13) and p18 (SEQ ID NO: 14) dye peptide complex into mice with melanoma MEL-23.

Figure 20:
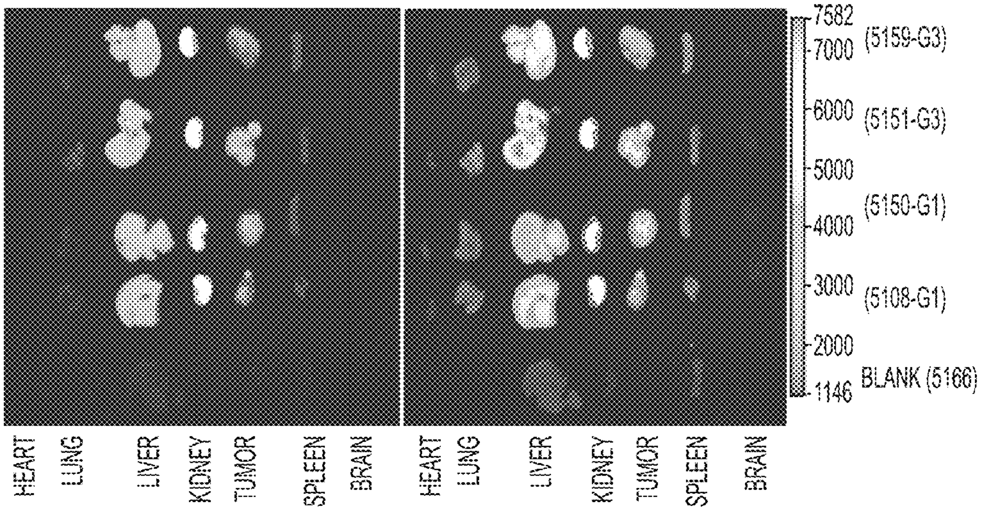

FIG. 20. Depicts photographs of mouse organs taken 24 hours after injection of 60 μM concentrations of p28 (SEQ ID NO: 13) into mice with MEL-23 tumors and organs.

Figure 21:
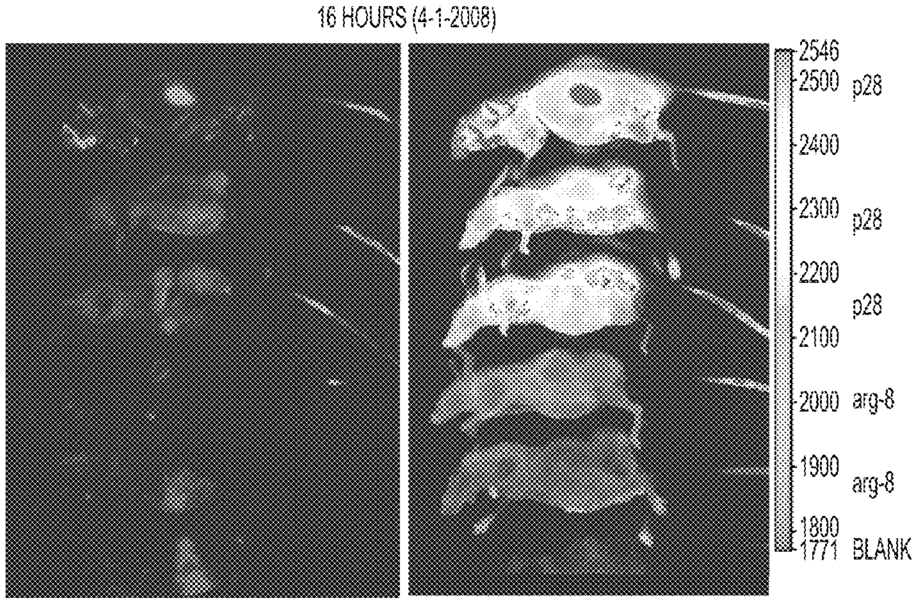

FIG. 21. Depicts side and back photographs of mice with melanoma MEL-23 tumors taken 16 hours after injections of 60 μM concentrations of p28 (SEQ ID NO: 13) and Arg-8 (SEQ ID NO: 3527).

Figure 22:
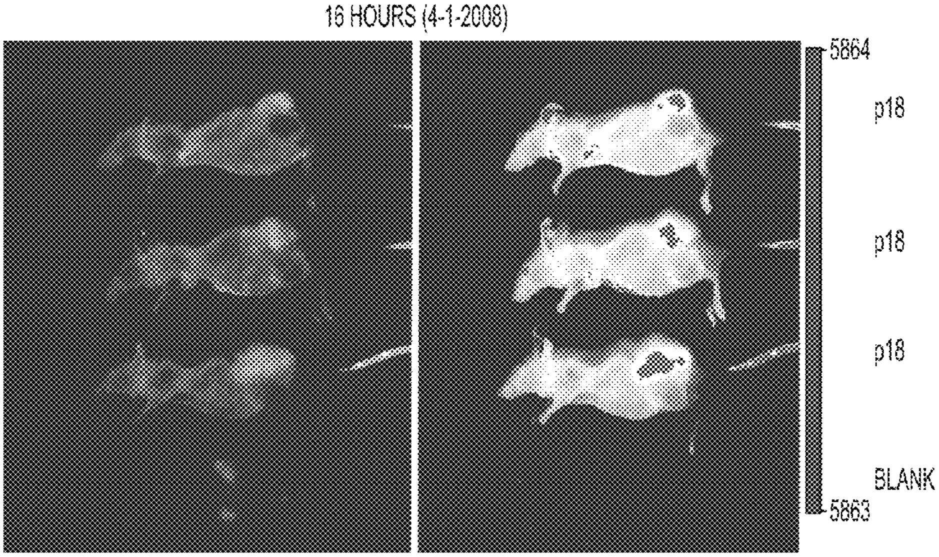

FIG. 22. Depicts side and back photographs of mice with melanoma MEL-23 tumors taken 16 hours after injections of 60 μM concentrations of p18 (SEQ ID NO: 14).

Figure 23:
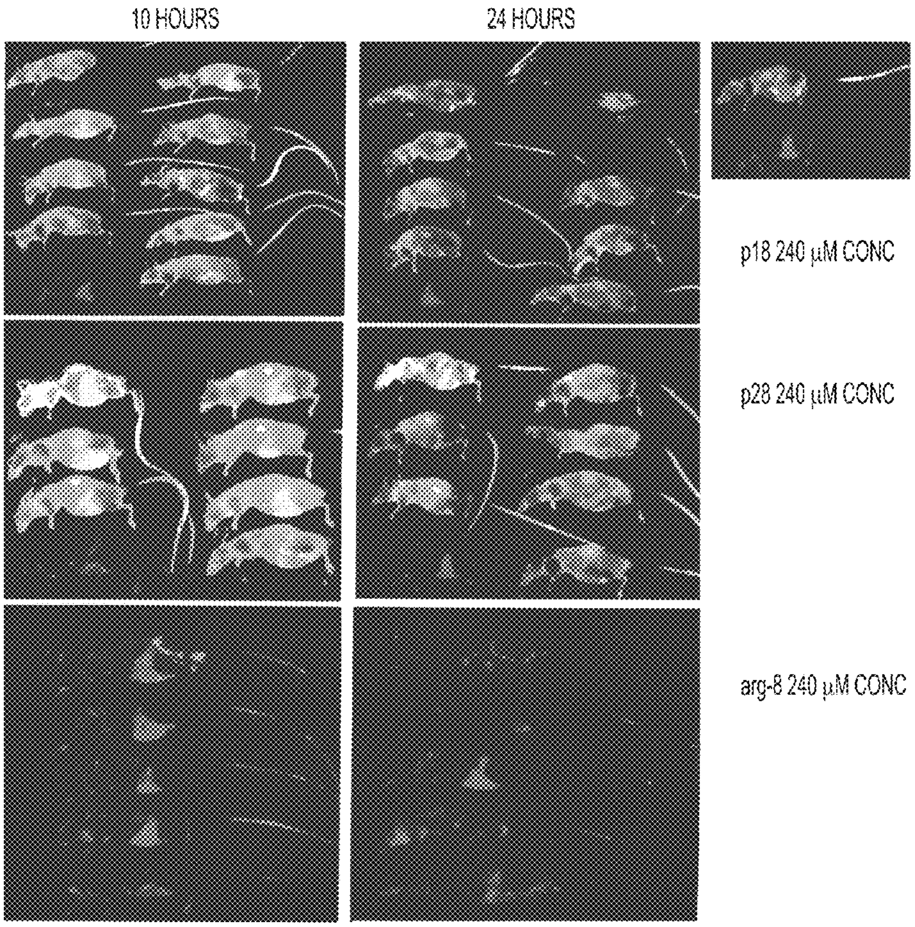

FIG. 23. Depicts side photographs of mice with tumors taken 10 and 24 hours after high dose treatment with 240 μM concentrations of p18 (SEQ ID NO: 14), p28 (SEQ ID NO: 13), and Arg-8 (SEQ ID NO: 3527).

Figure 24:
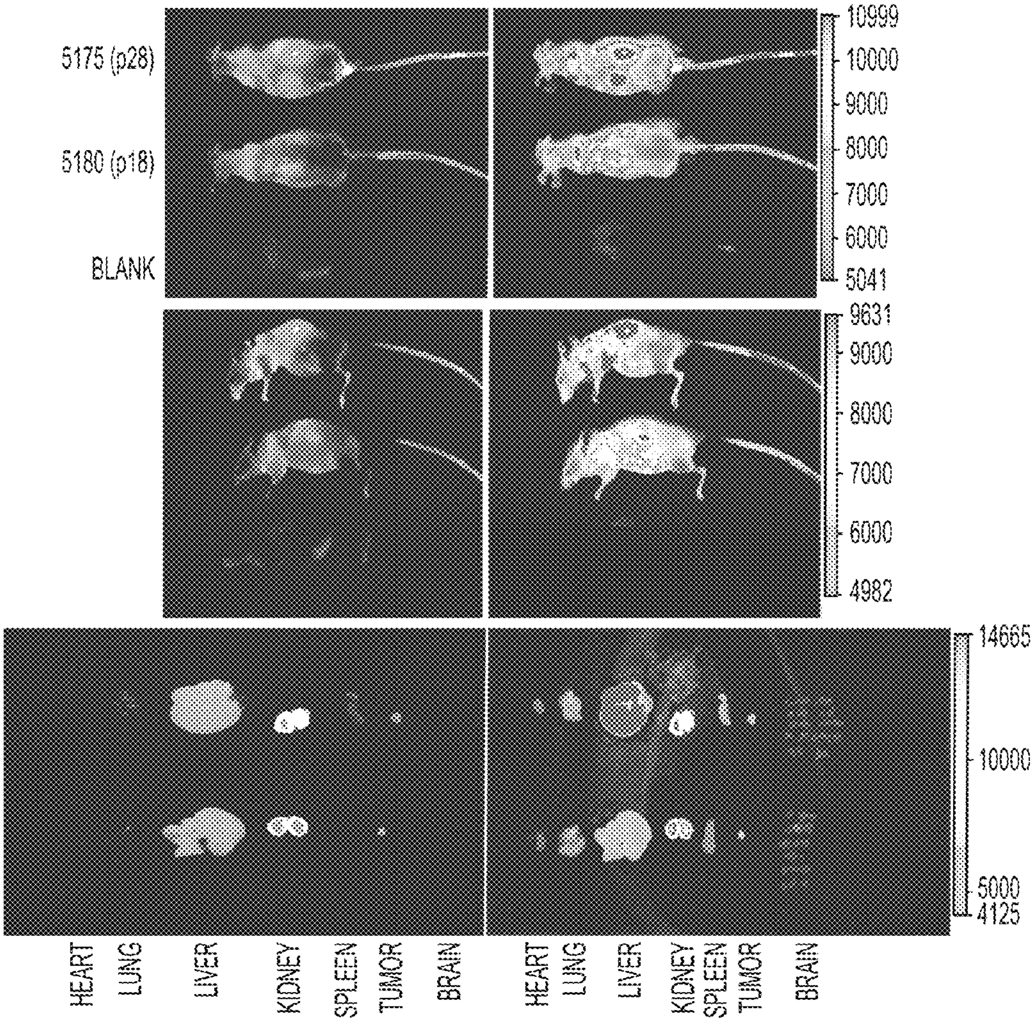

FIG. 24. Depicts side and back photographs of mice with MCF-7 tumors and organs taken 28 hours after high dose treatment with 240 μM concentrations of p18 (SEQ ID NO: 14), p28 (SEQ ID NO: 13), and Arg-8 (SEQ ID NO: 3527). Also depicts photographs of mouse organs with MCF-7 taken 28 hours after high dose treatment with 240 μM concentrations of p18 (SEQ ID NO: 14), p28 (SEQ ID NO: 13), and Arg-8 (SEQ ID NO: 3527).

Figure 25:
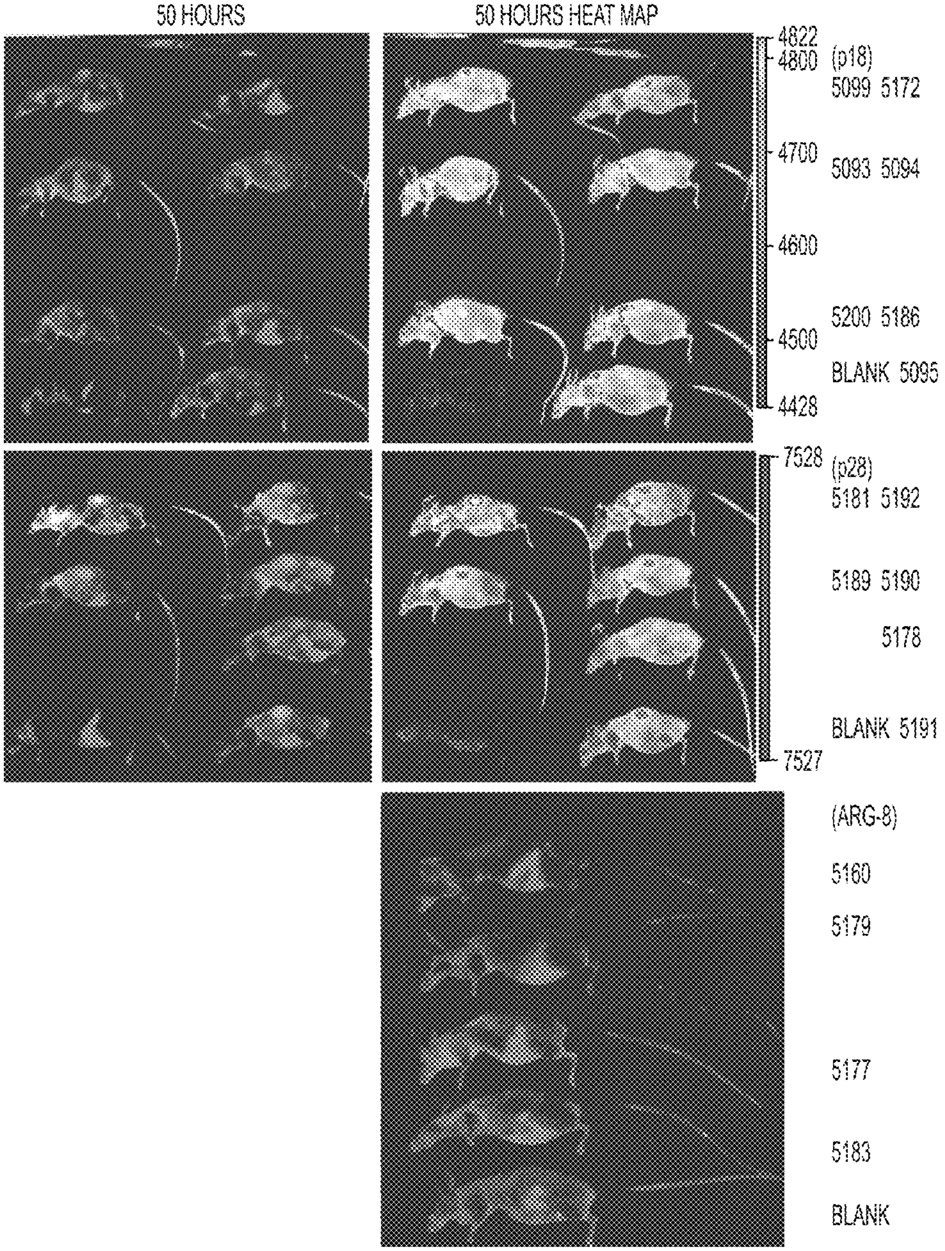

FIG. 25. Depicts side and back photographs of mice with tumors taken 50 hours after high dose treatment with 240 μM concentrations of p18 (SEQ ID NO: 14), p28 (SEQ ID NO: 13), and Arg-8 (SEQ ID NO: 3527).

Figure 26:
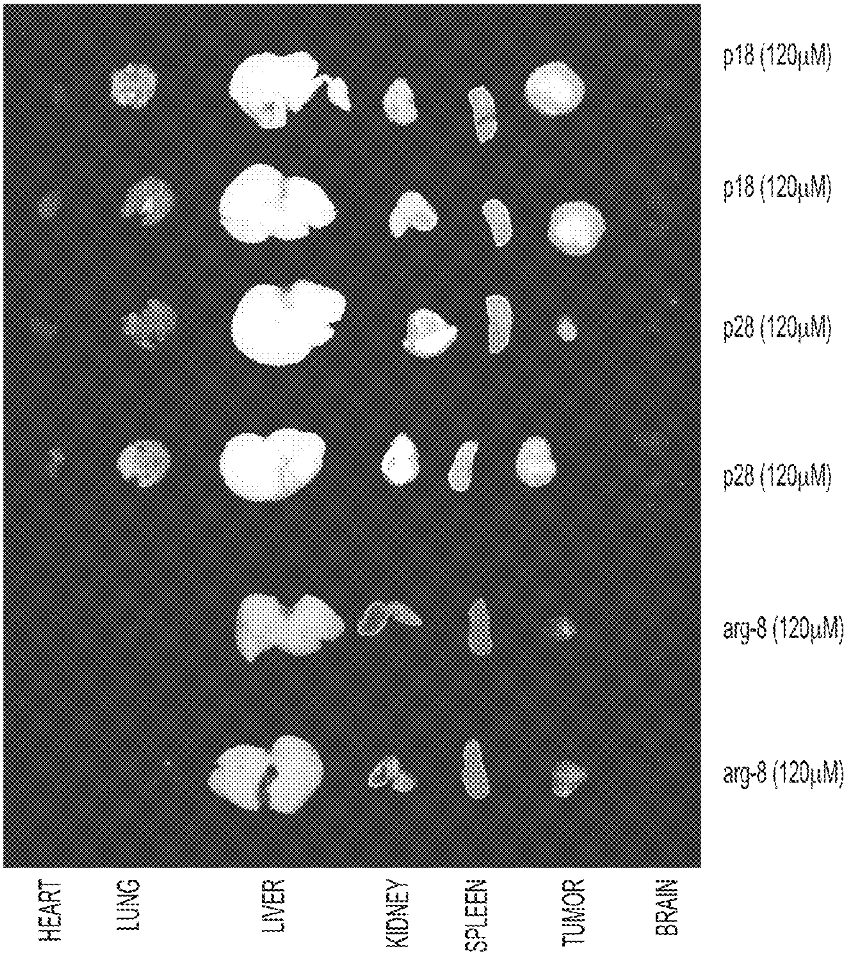

FIG. 26. Depicts photographs of mouse organs taken 24 hours after injection of 120 μM concentrations of p18 (SEQ ID NO: 14), p28 (SEQ ID NO: 13), and Arg-8 (SEQ ID NO: 3527) into the tail veins of mice with HCT-116 tumors and organs.

Figure 27A:
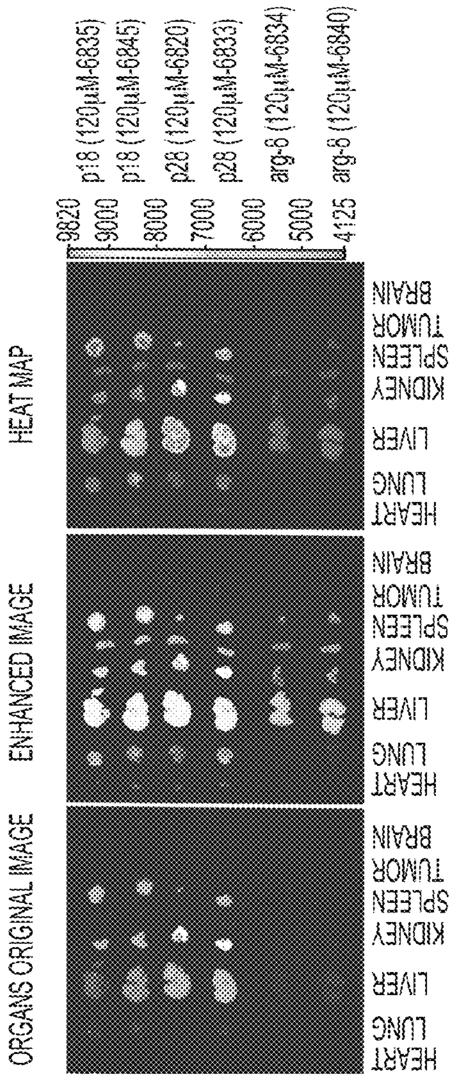
Figure 27B:
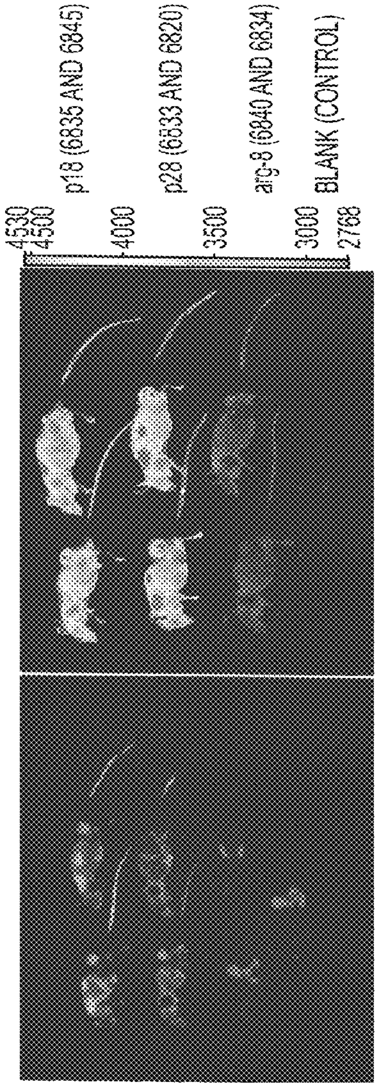

FIG. 27, (A) and (B). (A) Depicts photographs of mouse organs taken 24 hours after injection of 120 μM concentrations of p18 (SEQ ID NO: 14), p28 (SEQ ID NO: 13), and Arg-8 (SEQ ID NO: 3527) into the tail veins of mice with HCT-116 tumors and organs. (B) Depicts side photographs of mice with HCT-116 tumors taken 21 hours after injection of 120 μM concentrations of p18 (SEQ ID NO: 14), p28 (SEQ ID NO: 13), and Arg-8 (SEQ ID NO: 3527) into their tail veins.

Figure 28A:
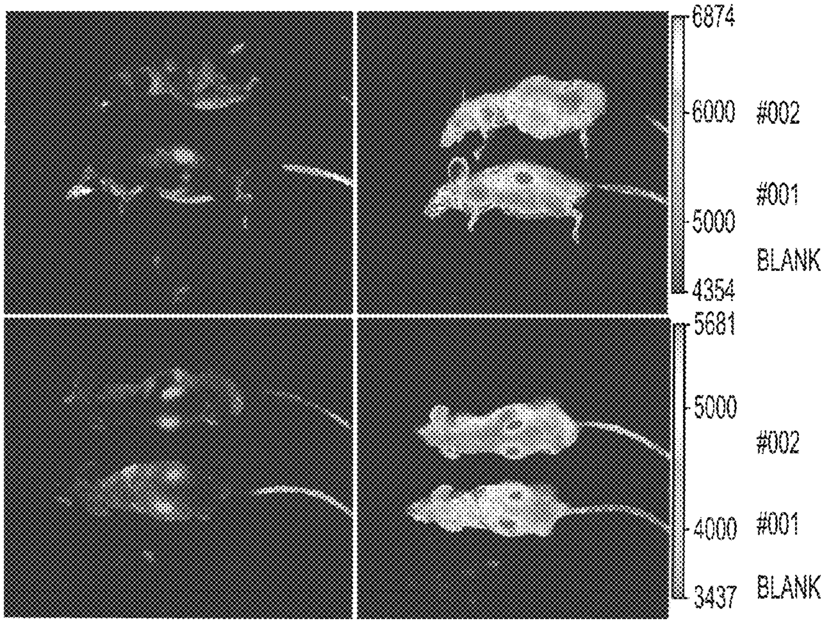
Figure 28B:
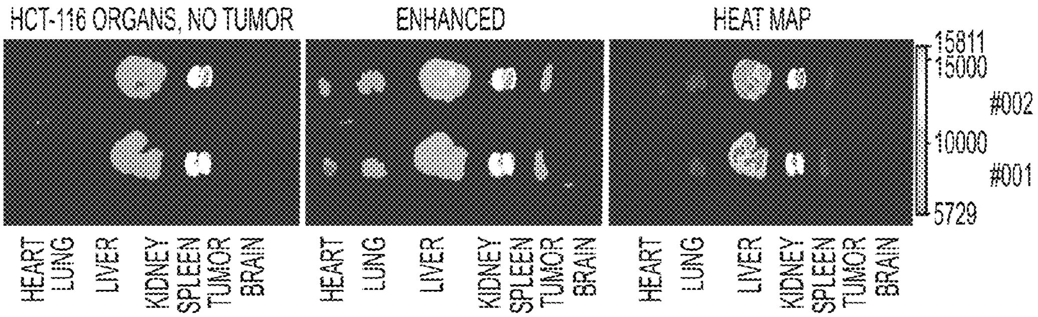

FIG. 28, (A) and (B). (A) Depicts side and back photographs of mice with HCT-116 24 hours after injection with 120 μM concentrations of p28 (SEQ ID NO: 13), 47 days after injection of 1 million cells into tail veins. (B) Depicts photographs of mouse organs taken from mice with HCT-116 4 hours after injection with 120 μM concentrations of p28 (SEQ ID NO: 13), 47 days after injection of 1 million cells into tail veins.

Figure 29:
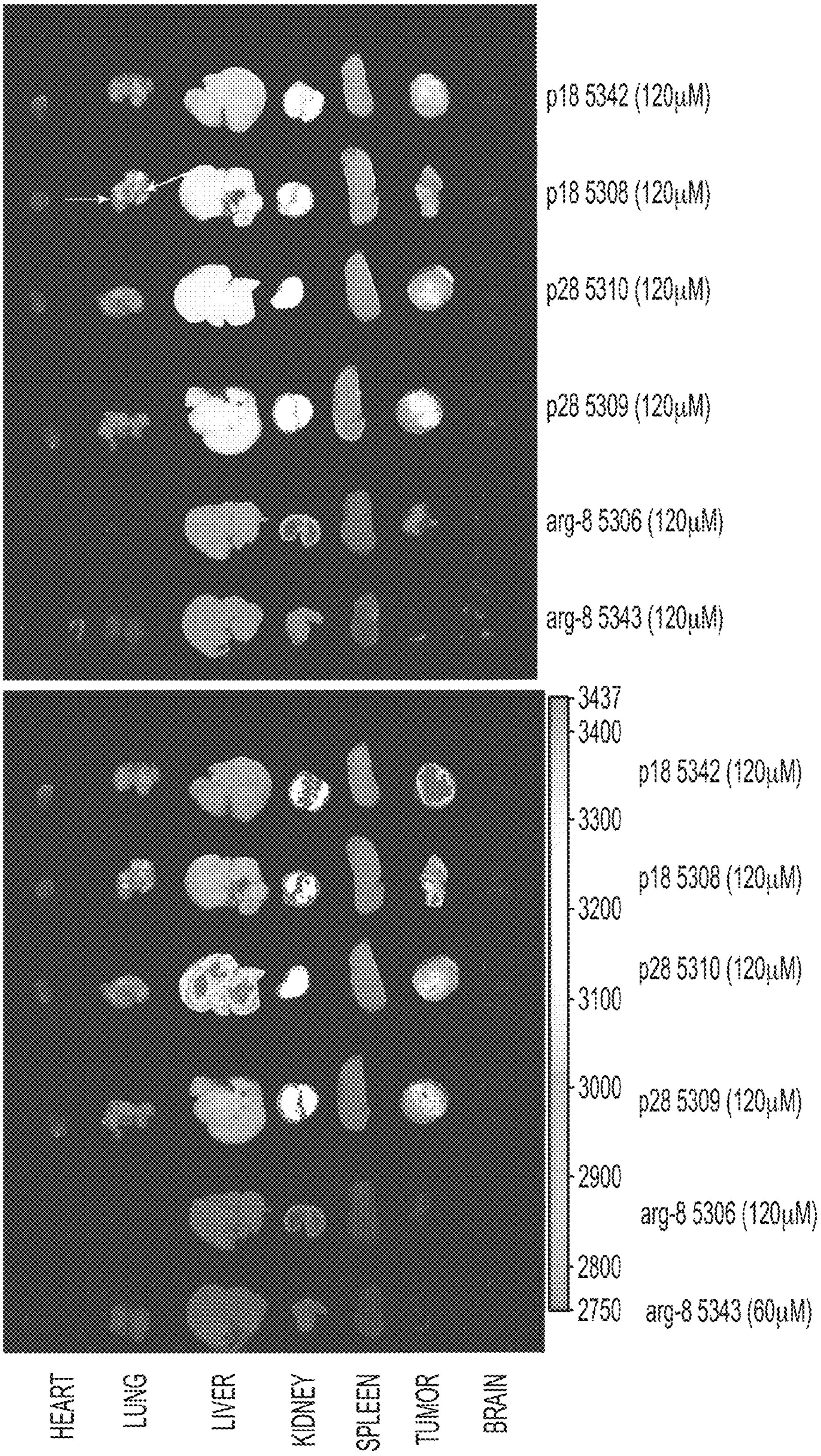

FIG. 29. Depicts photographs of organs from MEL-6 mice taken 24 hours after treatment with 120 μM concentrations of p18 (SEQ ID NO: 14), p28 (SEQ ID NO: 13), and Arg-8 (SEQ ID NO: 3527).

Figure 30A:
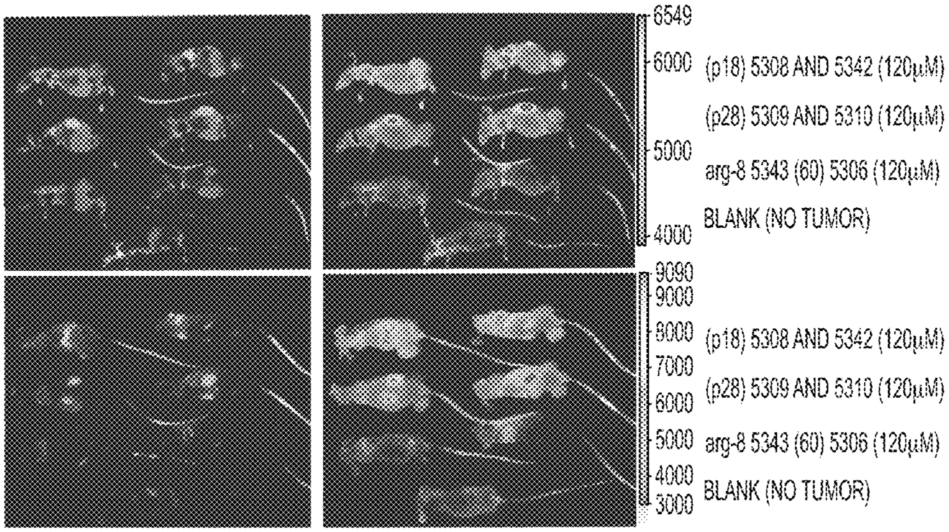
Figure 30B:
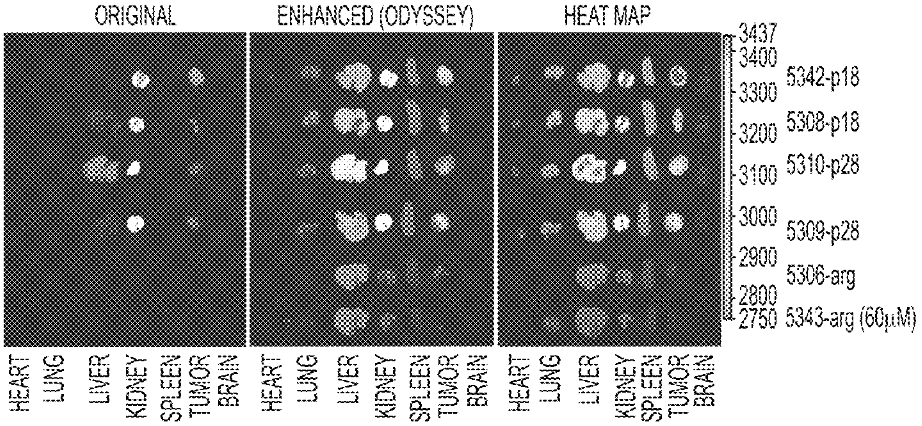

FIG. 30, (A) and (B). (A) Depicts side and back photographs of MEL-6 mice taken 22 hours after injection of 120 μM concentrations of p18 (SEQ ID NO: 14), p28 (SEQ ID NO: 13), and Arg-8 (SEQ ID NO: 3527), and 60 60 μM concentration of Arg-8 (SEQ ID NO: 3527). (B) Depicts photographs of MEL-6 mouse organs after treatment with 120 μM concentrations of p18 (SEQ ID NO: 14), p28 (SEQ ID NO: 13), and Arg-8 (SEQ ID NO: 3527), and 60 μM concentration of Arg-8 (SEQ ID NO: 3527).

Figure 31A:
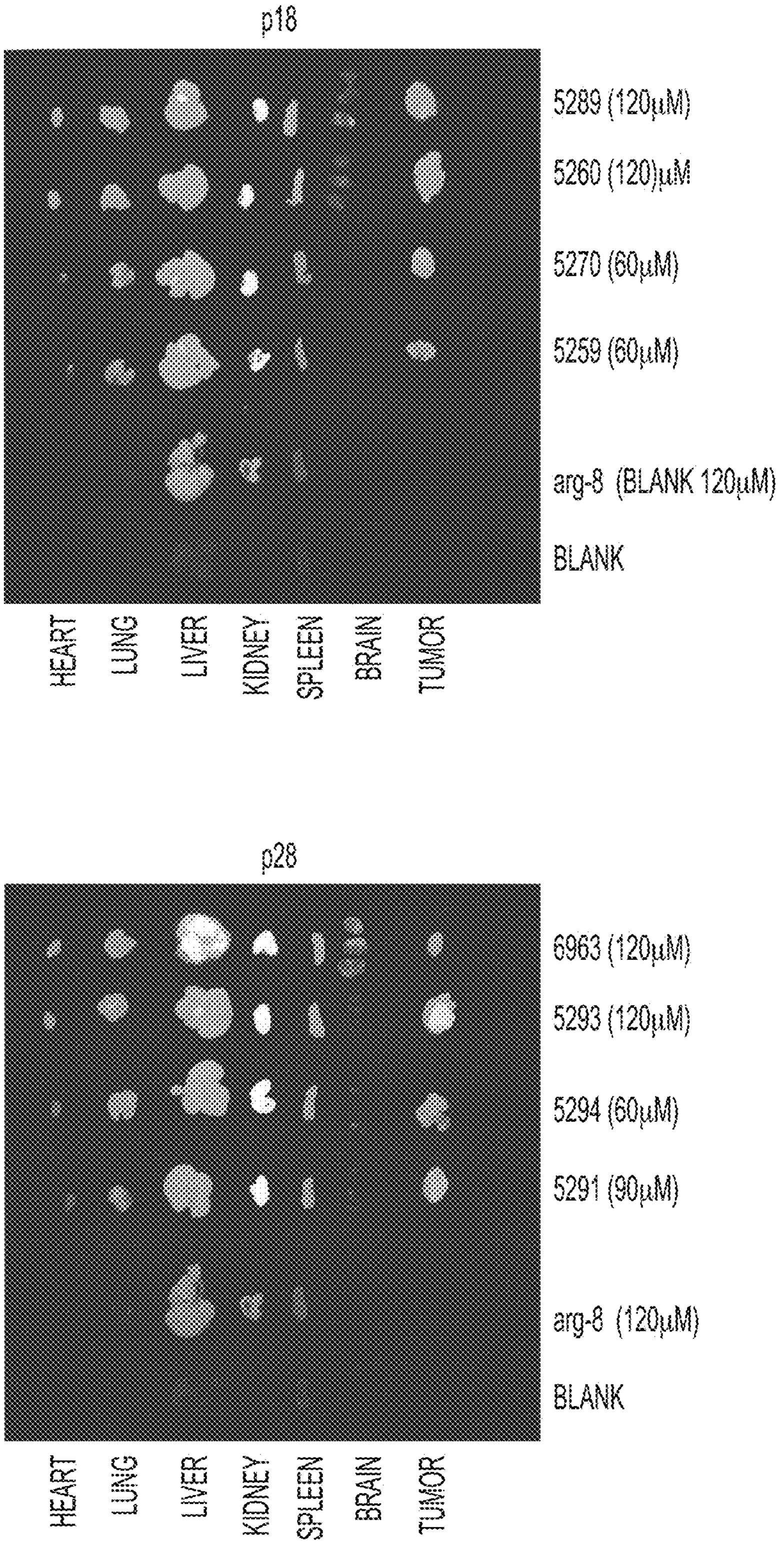
Figure 31B:
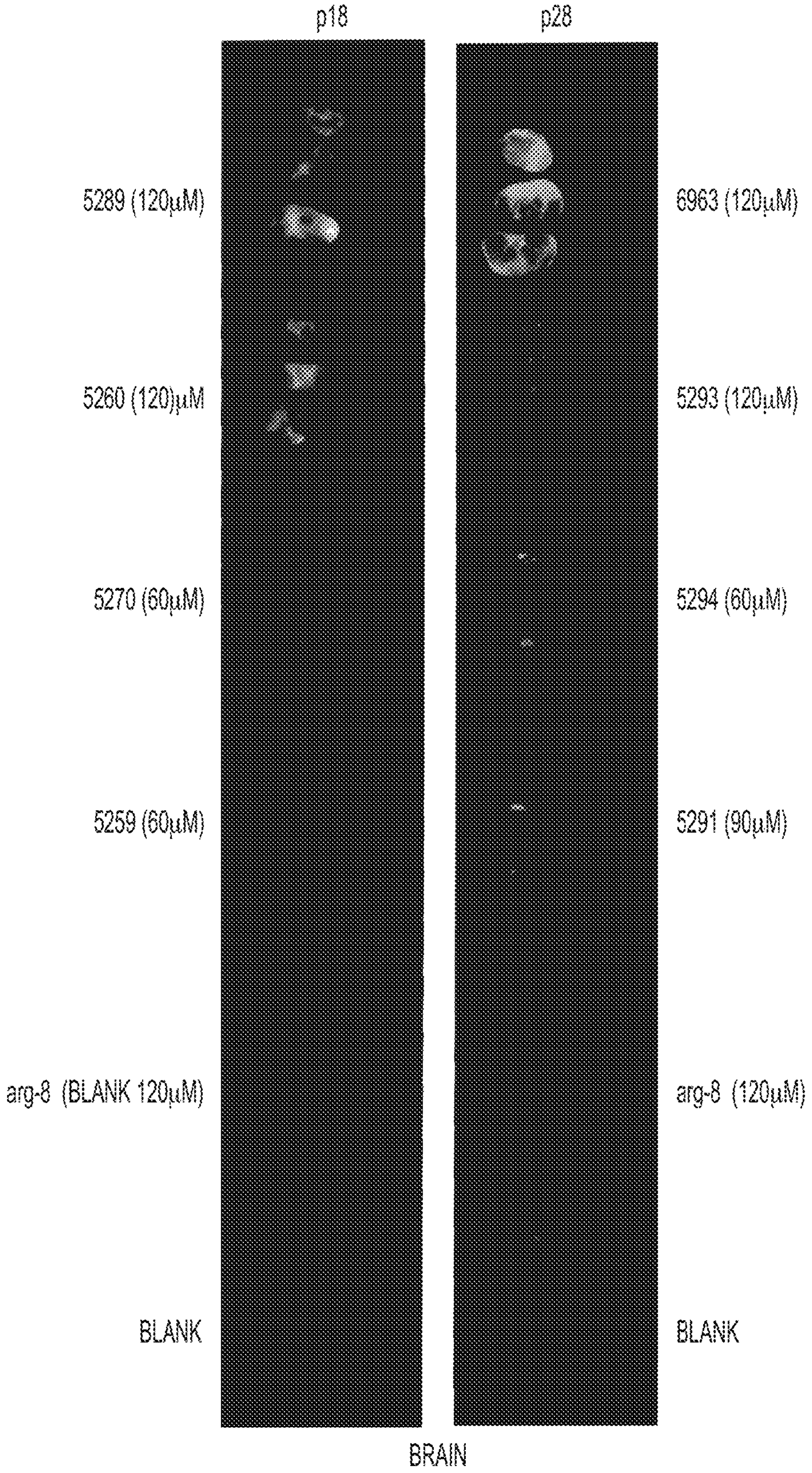

FIG. 31, (A) and (B). (A) Depicts photographs of organs from HT-1080 mice taken 22 hours after treatment with 60 and 120 μM concentrations of p18 (SEQ ID NO: 14), p28 (SEQ ID NO: 13), and Arg-8 (SEQ ID NO: 3527). (B) Depicts side-by-side photographs of brains from HT-1080 mice taken 22 hours after treatment with 60 and 120 μM concentrations of p18 (SEQ ID NO: 14), p28 (SEQ ID NO: 13), and Arg-8 (SEQ ID NO: 3527), demonstrating the differences between uptake of p18 (SEQ ID NO: 14) and p28 (SEQ ID NO: 13) into the brain.

Figure 32:
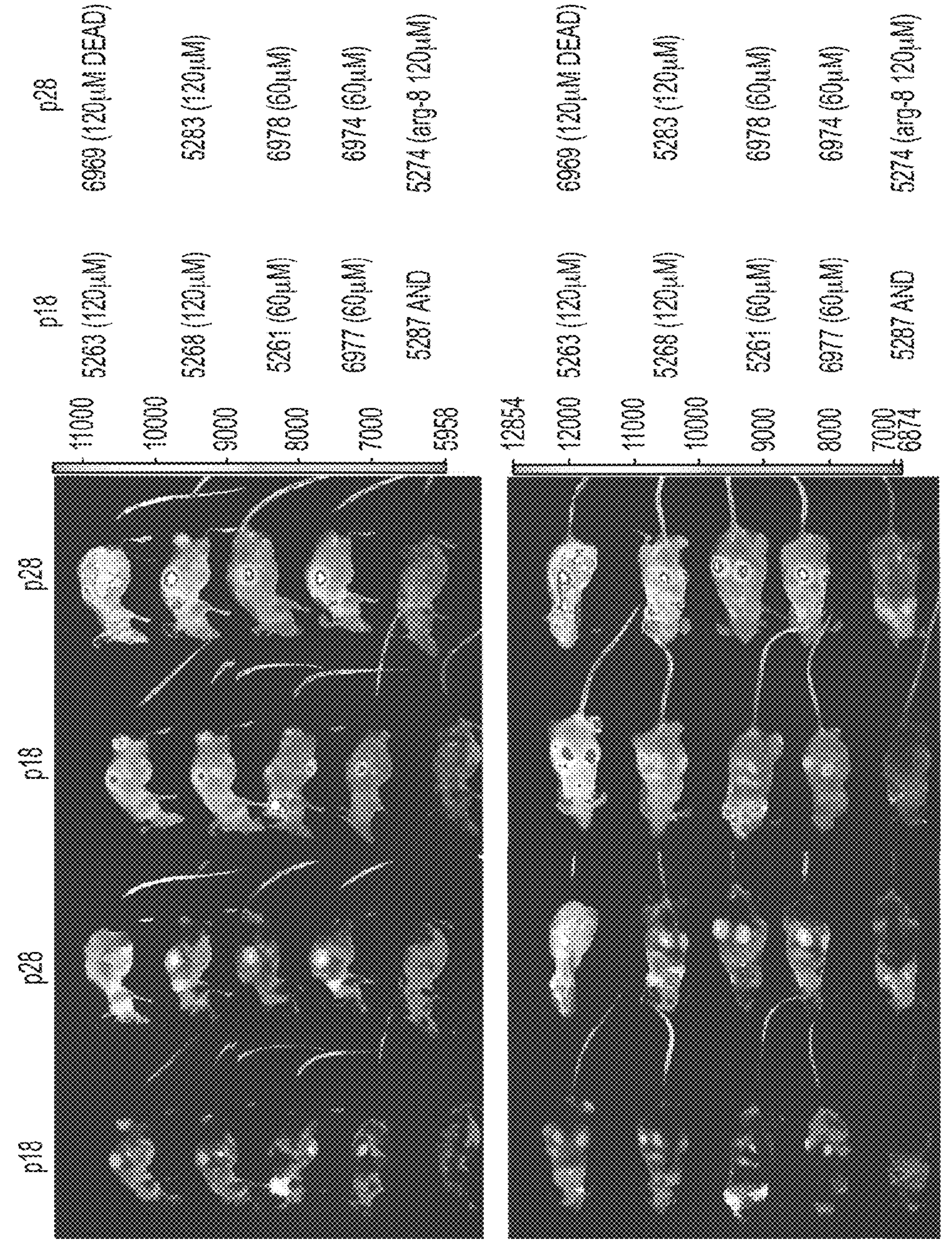

FIG. 32. Depicts side and back photographs of HT-1080 mice during Doxorubicin vs. p28 (SEQ ID NO: 13) study taken 16 hours after treatment with 60 and 120 μM concentrations of p18 (SEQ ID NO: 14), p28 (SEQ ID NO: 13), and Arg-8 (SEQ ID NO: 3527).

Figure 33A:
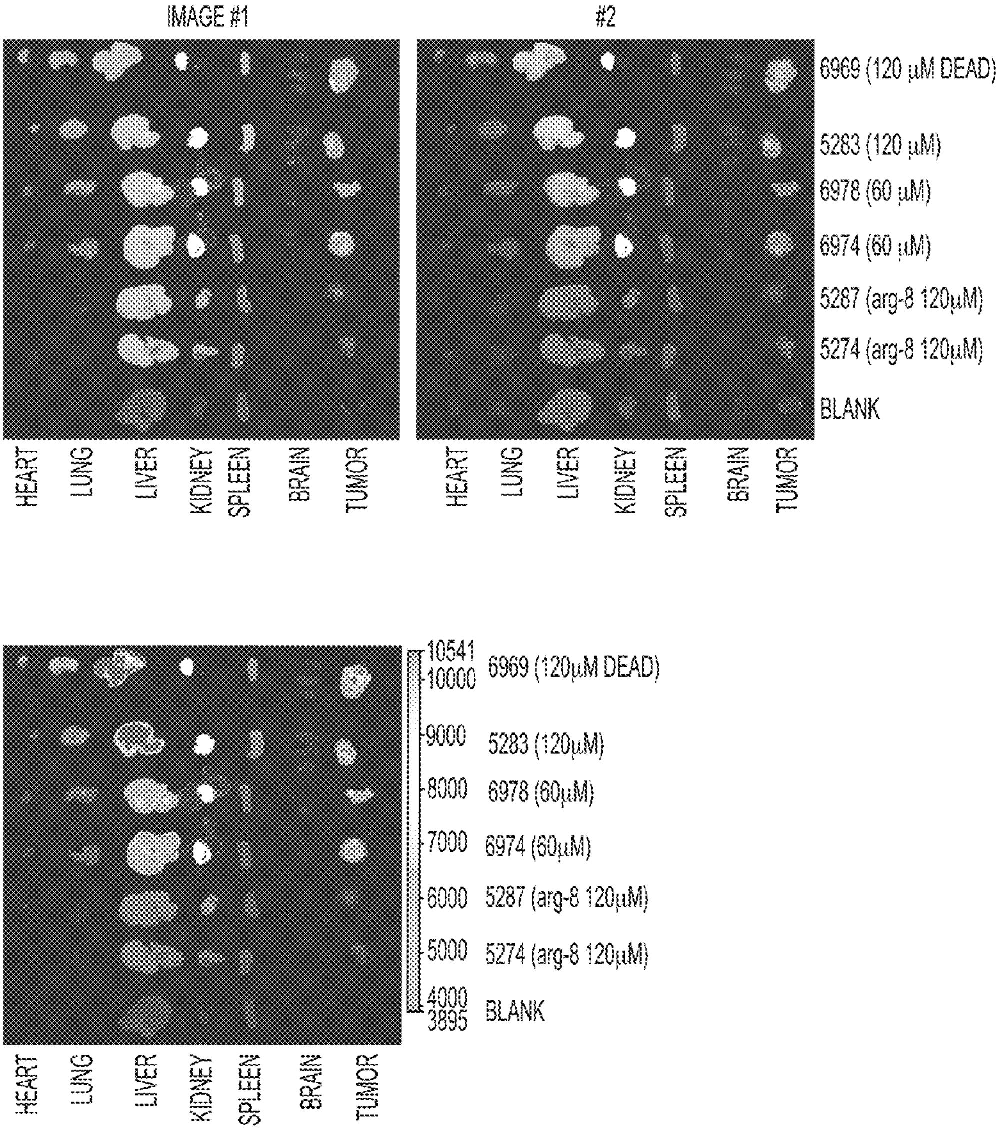
Figure 33B:
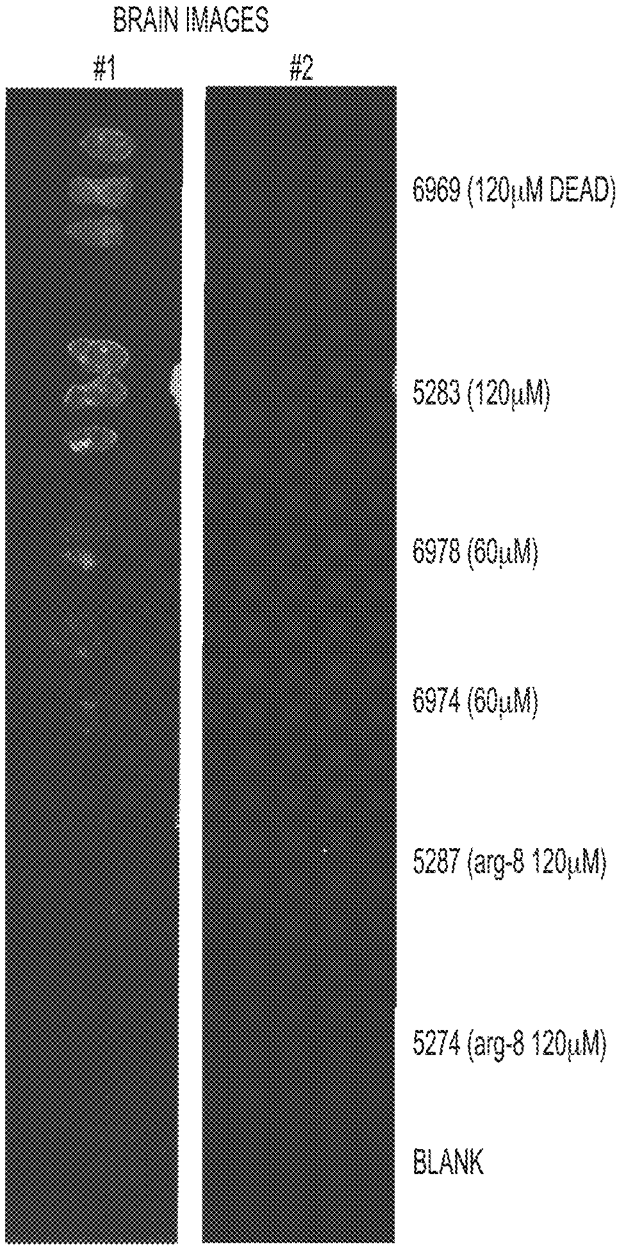

FIG. 33, (A) and (B). (A) Depicts photographs of organs from HT-1080 mice taken 22 hours after treatment with 60 and 120 μM concentrations of p28 (SEQ ID NO: 13) and Arg-8 (SEQ ID NO: 3527). (B) Depicts side-by-side photographs of brains from HT-1080 mice taken 22 hours after treatment with 60 and 120 μM concentrations of p28 (SEQ ID NO: 13) and Arg-8 (SEQ ID NO: 3527).

Figure 34A:
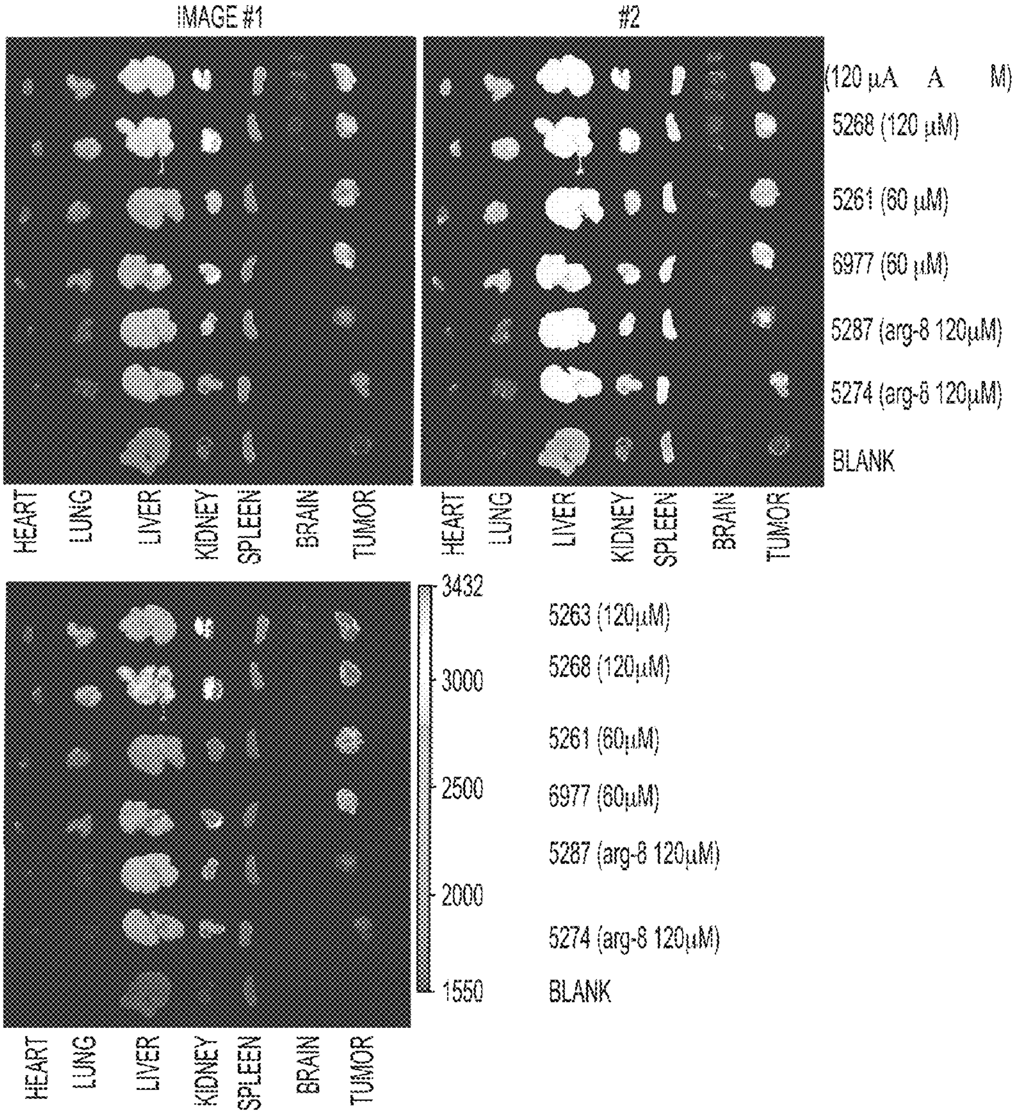
Figure 34B:
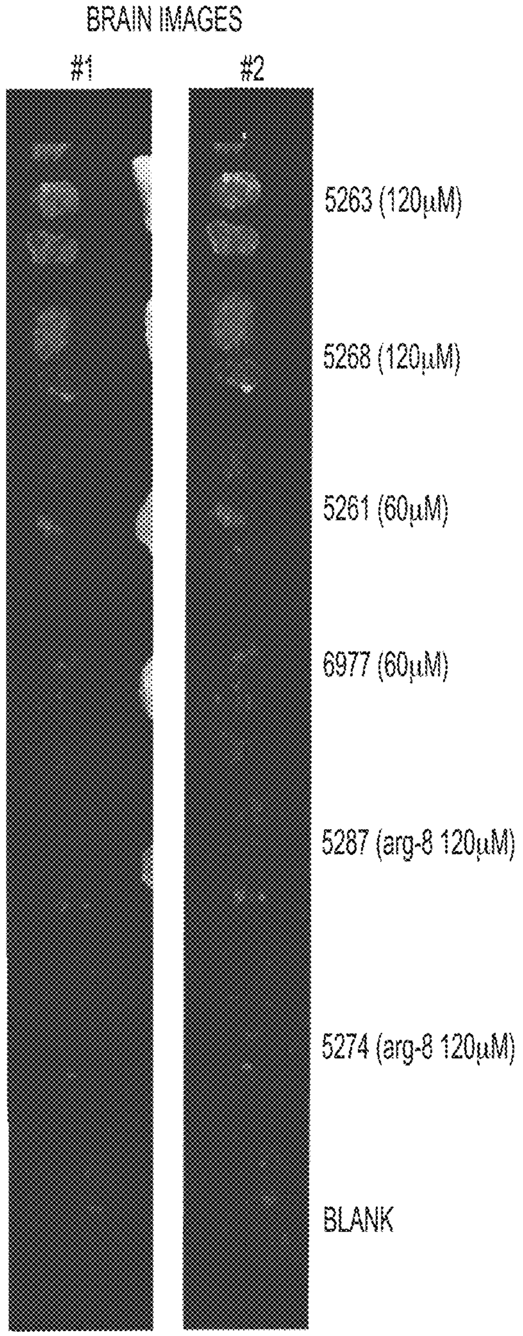

FIG. 34, (A) and (B). (A) Depicts photographs of organs from HT-1080 mice taken 22 hours after treatment with 60 and 120 μM concentrations of p18 (SEQ ID NO: 14) and Arg-8 (SEQ ID NO: 3527). (B) Depicts side-by-side photographs of brains from HT-1080 mice taken 22 hours after treatment with 60 and 120 μM concentrations of p18 (SEQ ID NO: 14) and Arg-8 (SEQ ID NO: 3527).

FIG. 35, (A) through (E). Depicts photographs of HT-1080 mice with lung metastases treated via their tail veins with (A) 3 mg/kg Doxorubicin IP, 3 treatments; (B) 5 mg/kg IP p28 (SEQ ID NO: 13) daily; (C) PBS control, PBS IP daily; (D) 10 mg/kg IP p28 (SEQ ID NO: 13) daily; (E) 20 mg/kg IP daily.

Figure 36A:
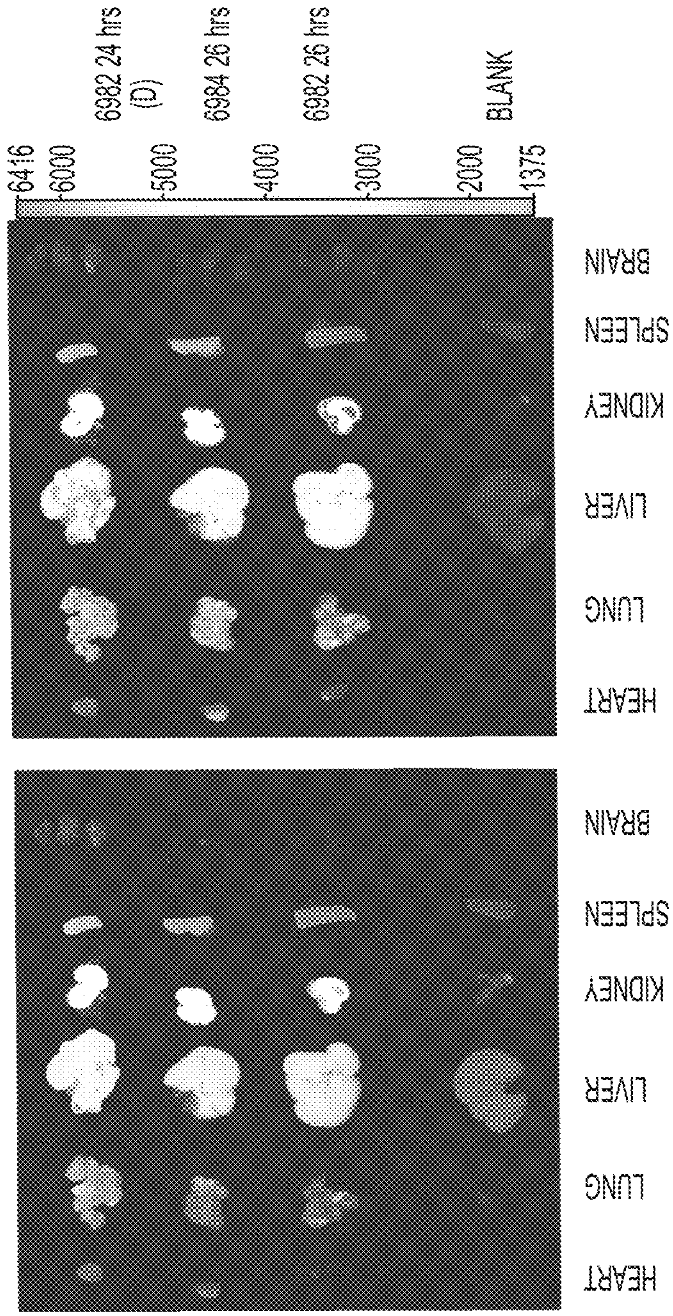
Figure 36B:
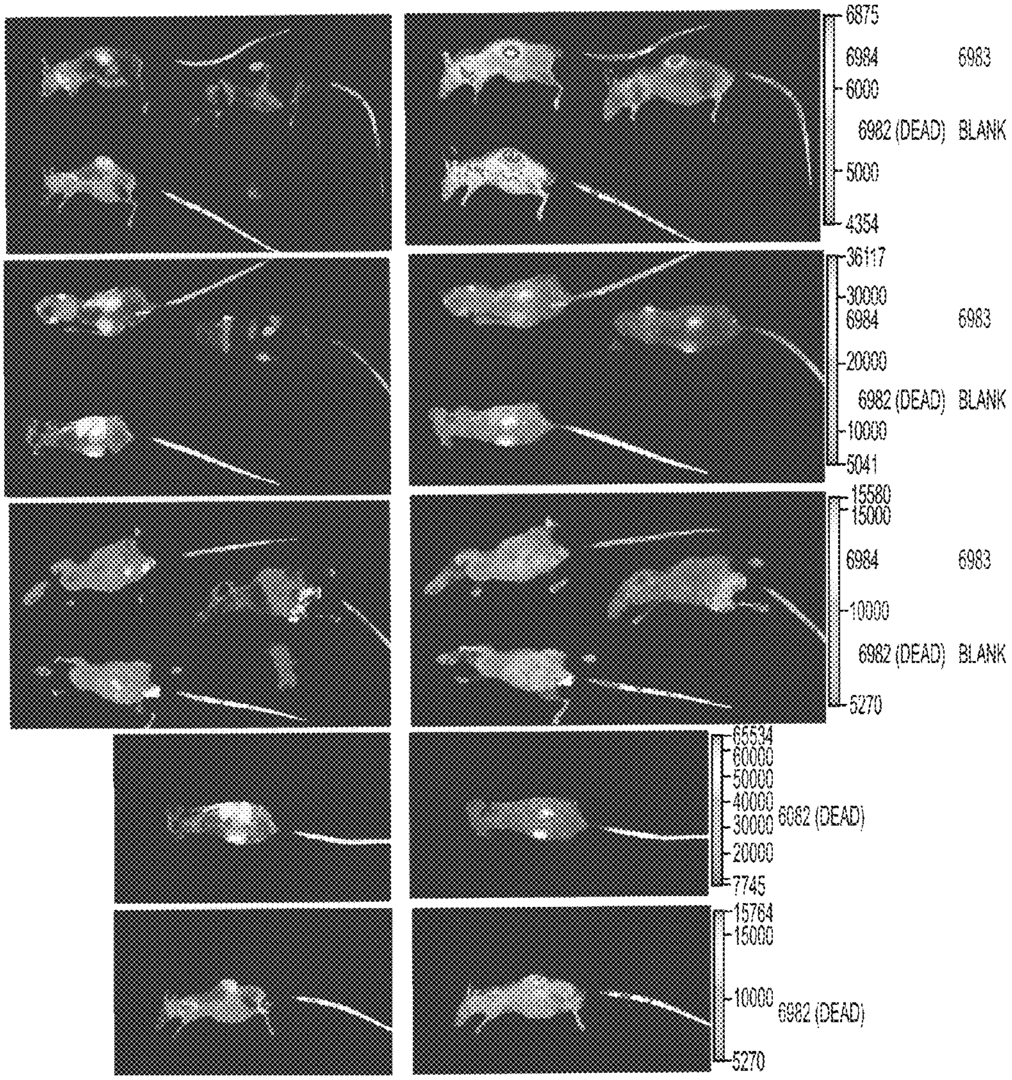

FIG. 36, (A) and (B). (A) Depicts photographs of organs from HT-1080 mice in an animal study, whereby $1\times10^6$ cells are injected into tail veins (43 days) and all treated mice have lung metastases, taken 24 and 26 hours after 60 μM concentrations of p28 (SEQ ID NO: 13) injected into tail veins. Animal 6982 was dead when photographed. (B) Depicts side and back photographs of HT-1080 mice in an animal study, whereby $1\times10^6$ cells are injected into tail veins (43 days), taken 22 hours after 60 μM concentrations of p28 (SEQ ID NO: 13) injected into tail veins. Animal 6982 was dead when photographed.

Figure 37:
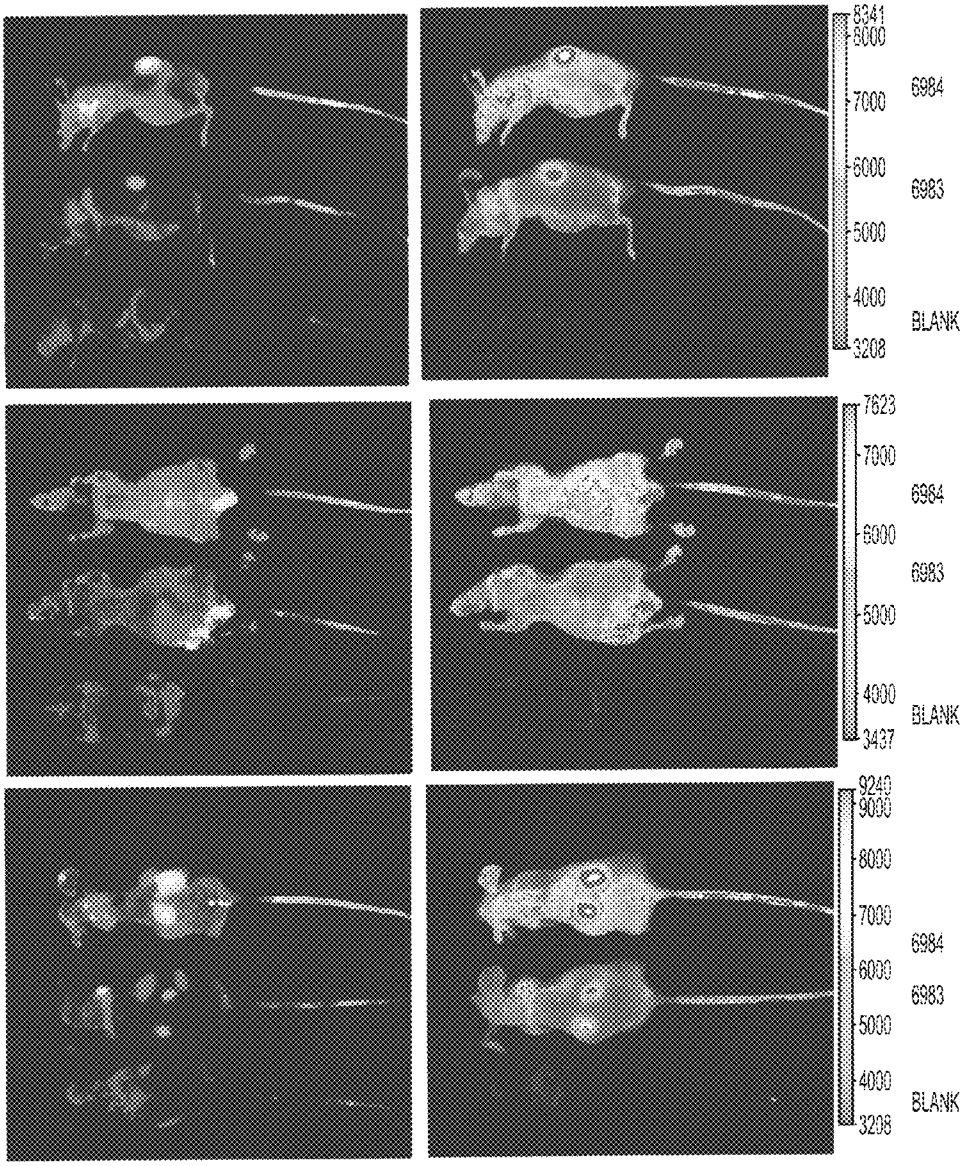

FIG. 37. Depicts side and back photographs of HT-1080 mice in an animal study, whereby $1\times10^6$ cells are injected into tail veins (43 days), taken 26 hours after 60 μM concentrations of p28 (SEQ ID NO: 13) injected into tail veins.

Figure 38A:
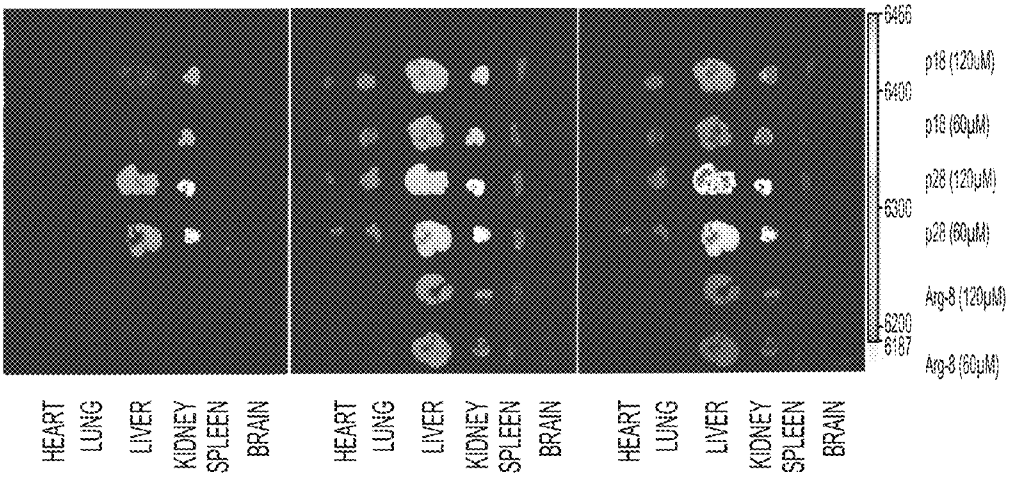
Figure 38B:
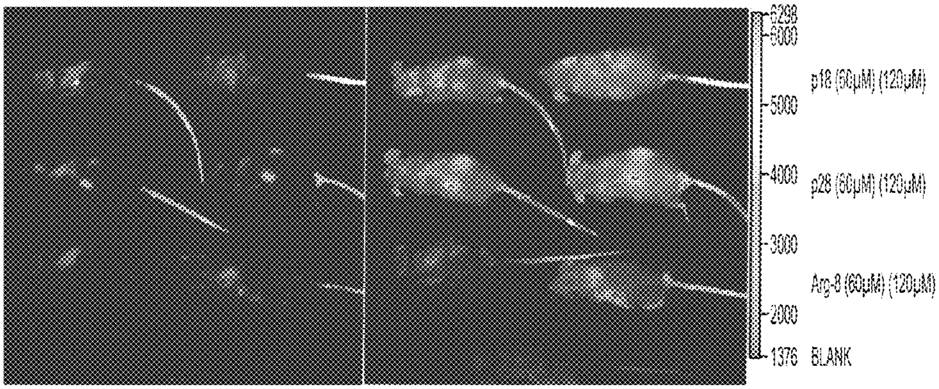

FIG. 38, (A) and (B). Depicts photographs of (A) organs from mice and (B) back views of mice in Balb-C peptide study taken 12 hours after treatment with 60 and 120 μM concentrations of p18 (SEQ ID NO: 14), p28 (SEQ ID NO: 13), and Arg-8 (SEQ ID NO: 3527).

Figure 39A:
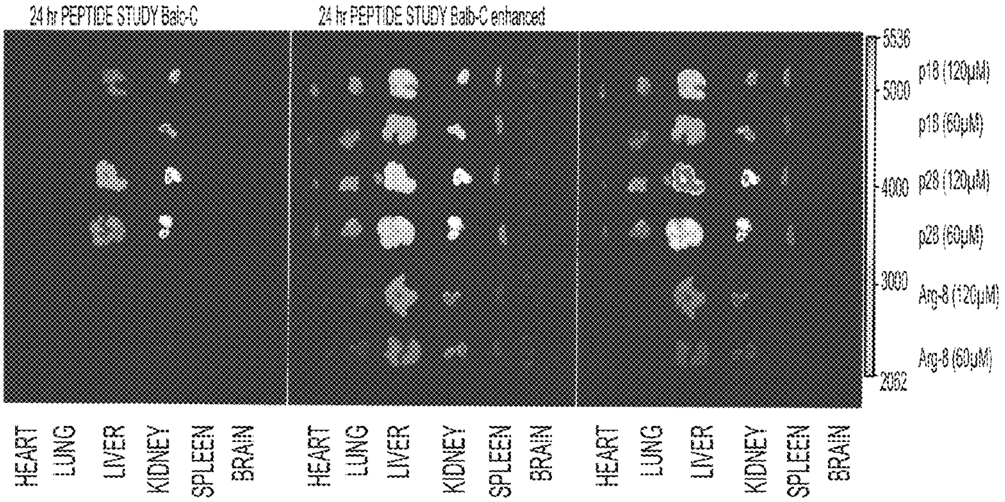
Figure 39B:
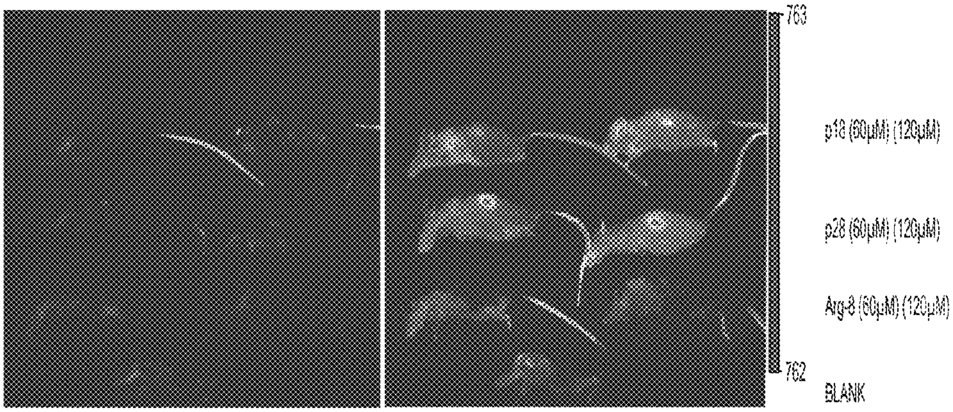

FIG. 39, (A) and (B). Depicts photographs of (A) organs from mice and (B) side views of mice in Balb-C peptide study taken 24 hours after treatment with 60 and 120 μM concentrations of p18 (SEQ ID NO: 14), p28 (SEQ ID NO: 13), and Arg-8 (SEQ ID NO: 3527).

Figure 40:
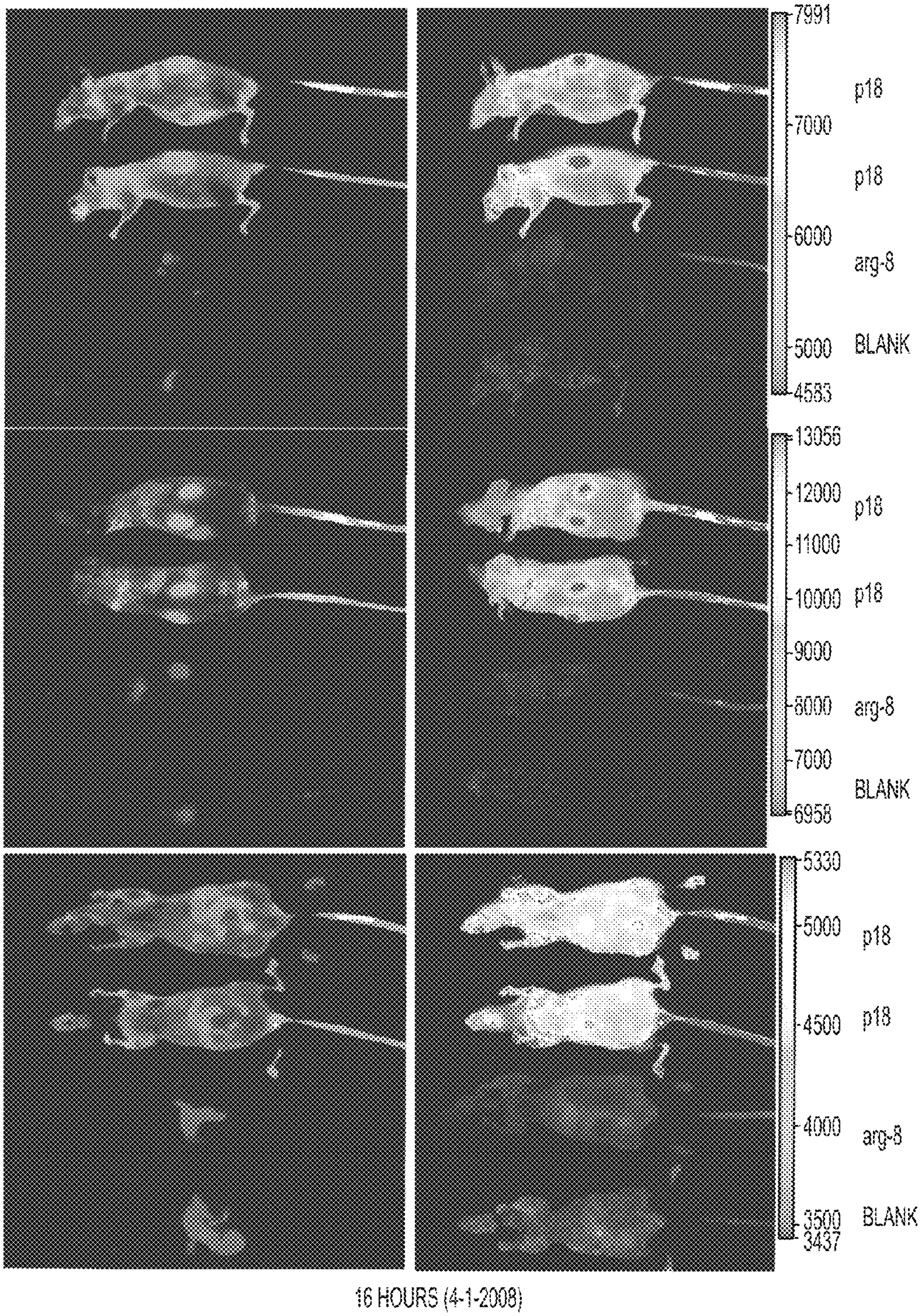
Figure 41A:
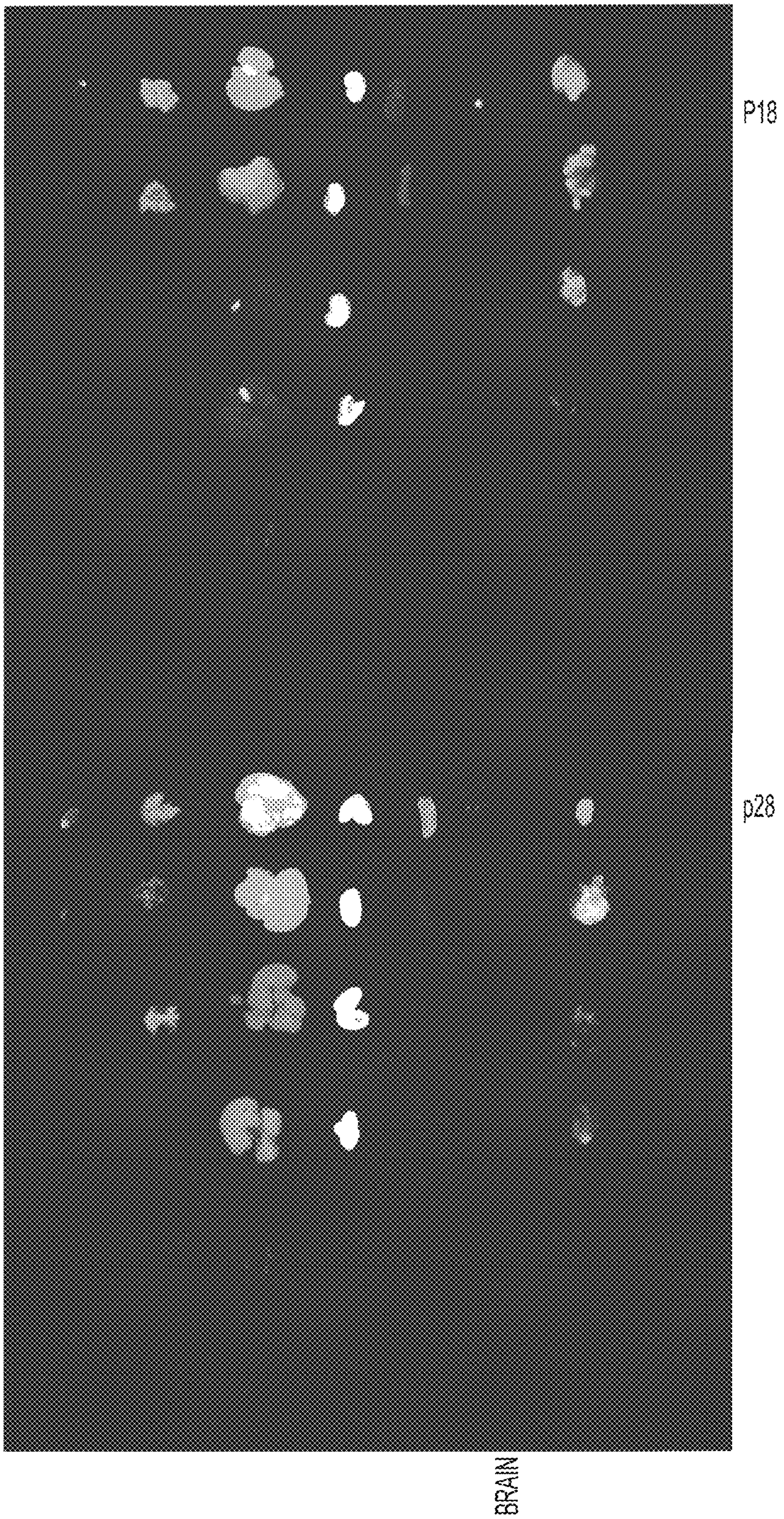
Figure 41B:
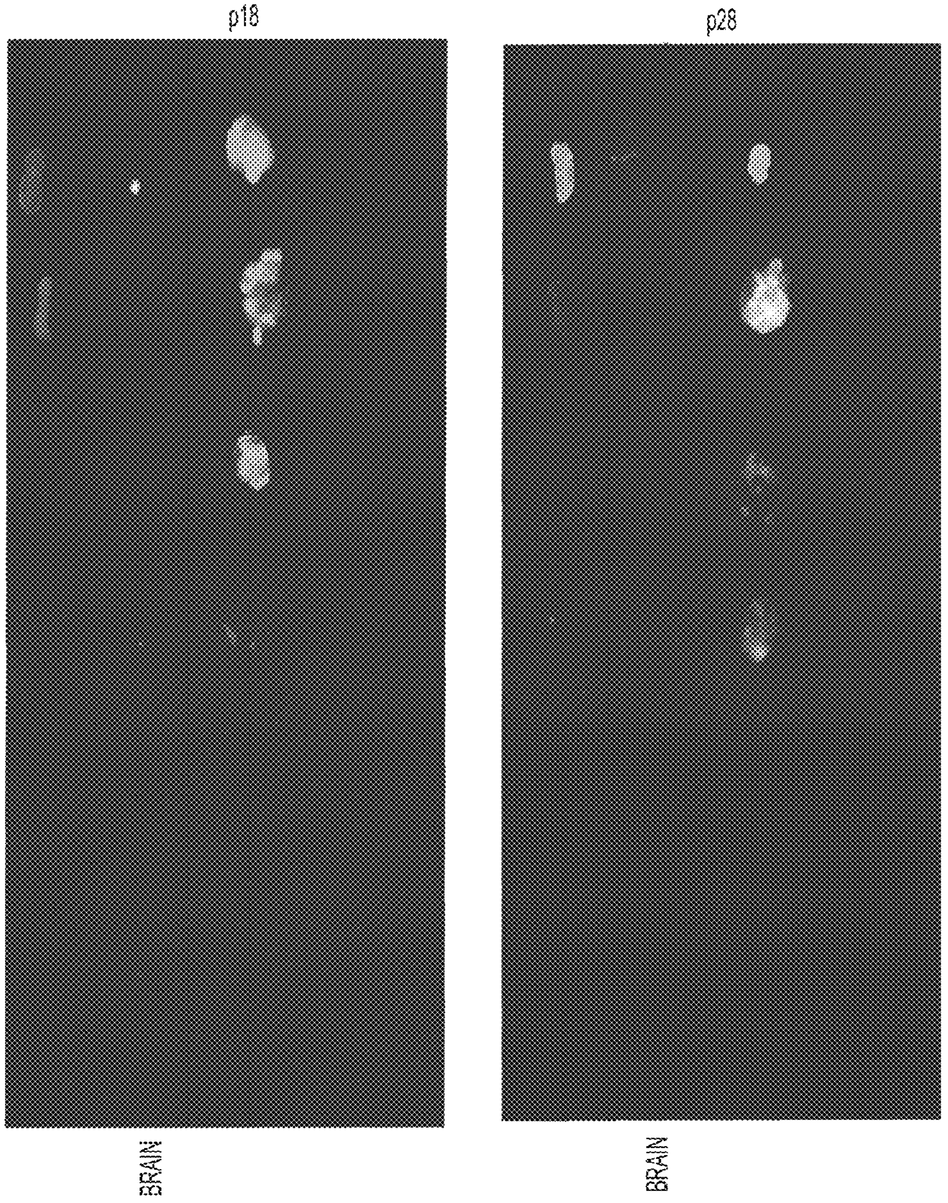
Figure 41C:
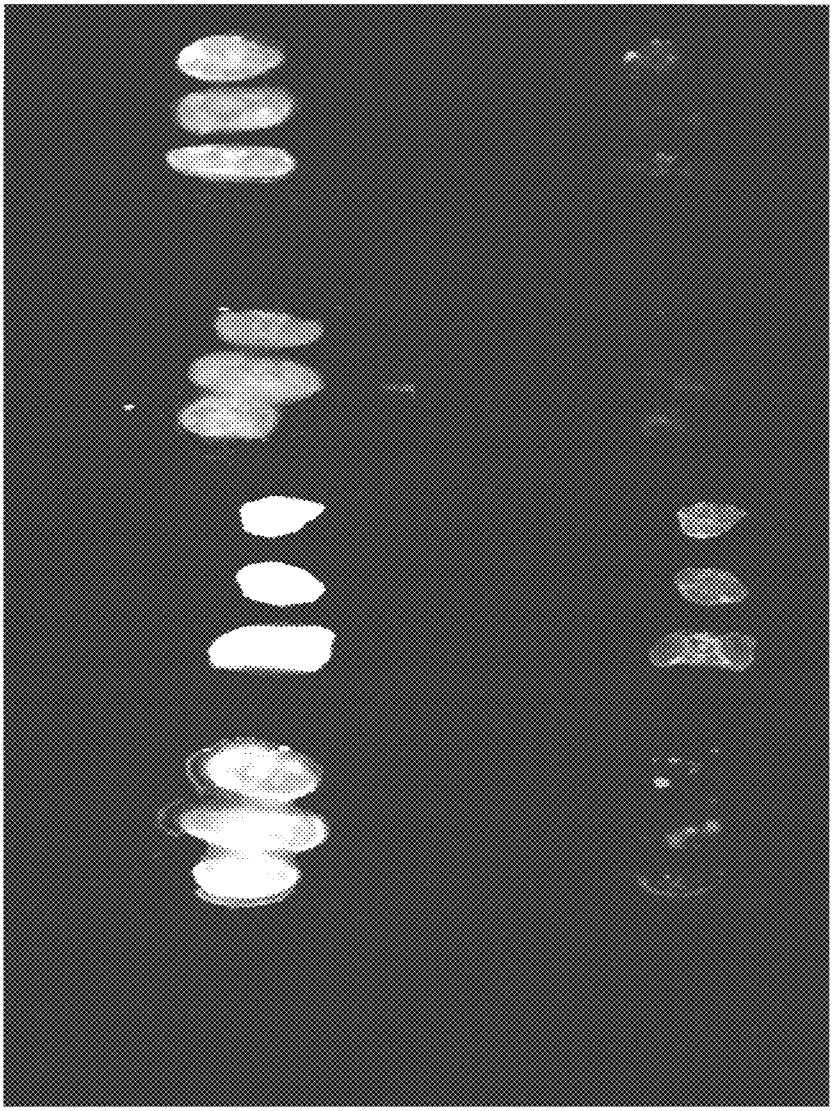
Figure 41D:
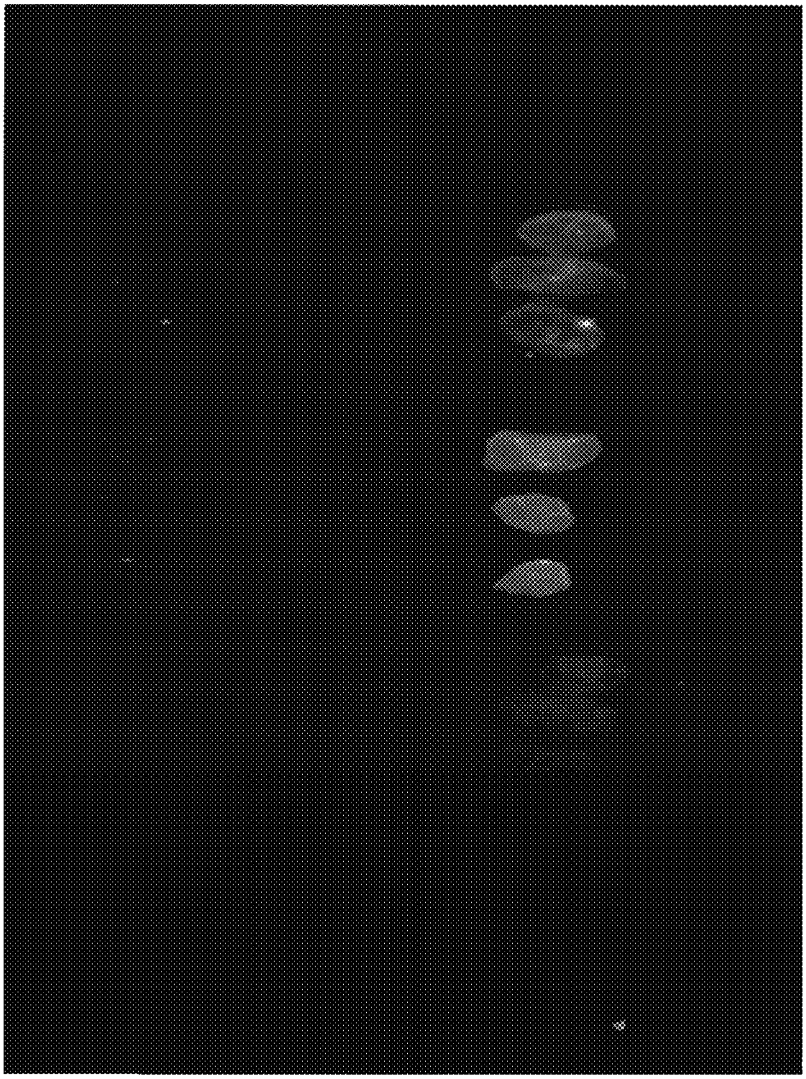

FIG. 40. Depicts side and back photographs of MEL-6 mice (0.5 million cells injected via tail vein) 16 hours after injection into tail veins of 60 μM concentrations of p18 (SEQ ID NO: 14) and Arg-8 (SEQ ID NO: 3527).

FIG. 41, (A) through (D). Depicts photographs of mouse organs, and specifically mouse brains, after treatment with p18 (SEQ ID NO: 14) and p28 (SEQ ID NO: 13).

Figure 42:
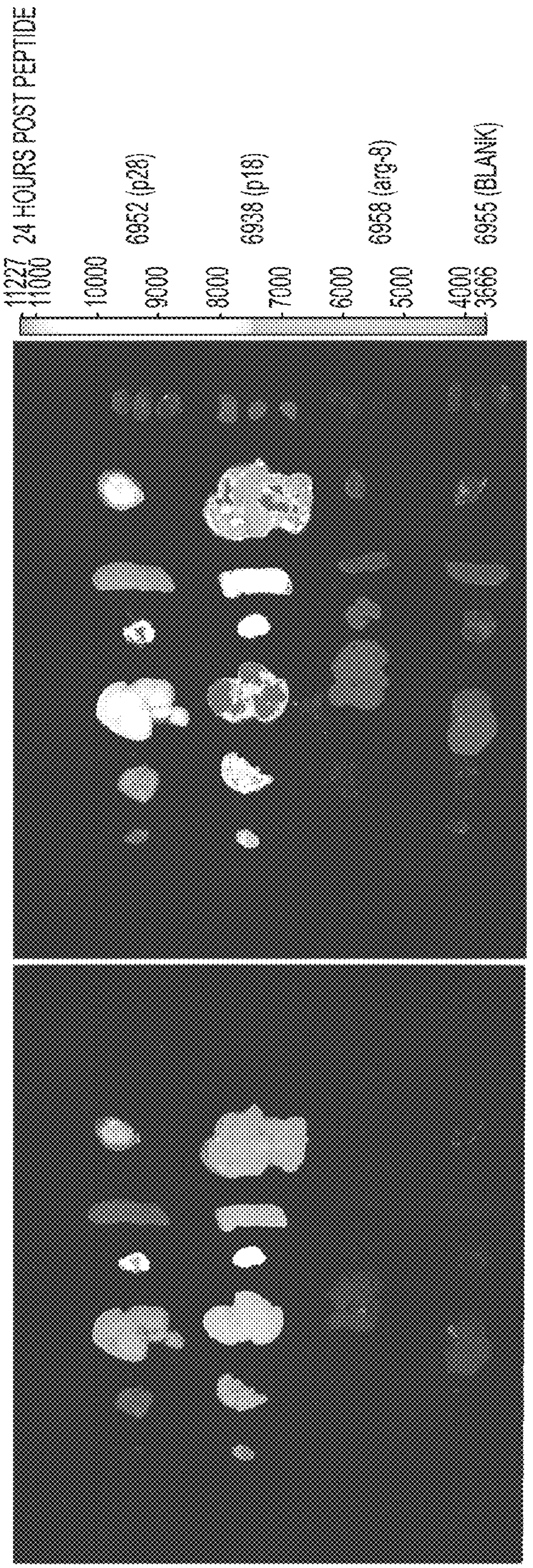

FIG. 42. Depicts photographs of organs from MEL-6 mice taken 24 hours after treatment with p28 (SEQ ID NO: 13), p18 (SEQ ID NO: 14), and Arg-8 (SEQ ID NO: 3527).

Figure 43A:
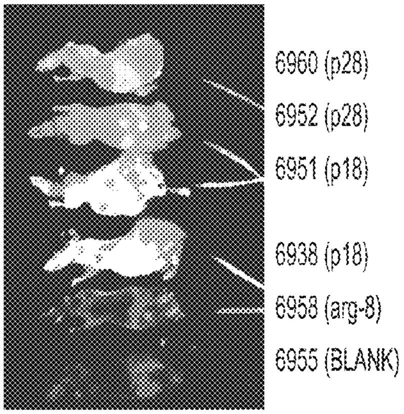
Figure 43B:
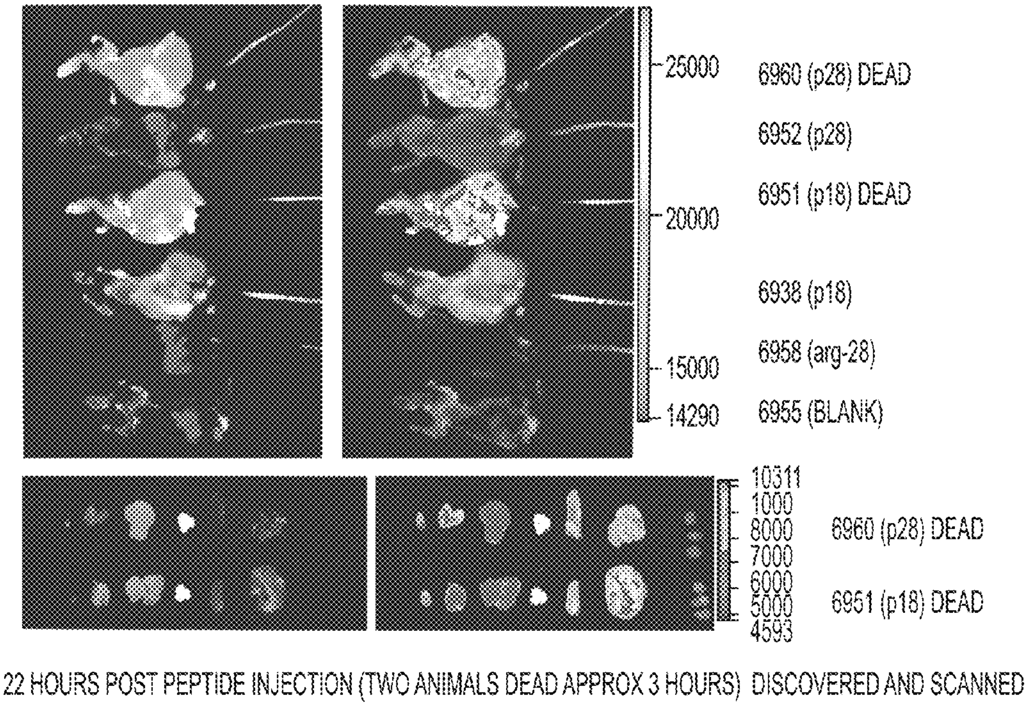
Figure 43C:
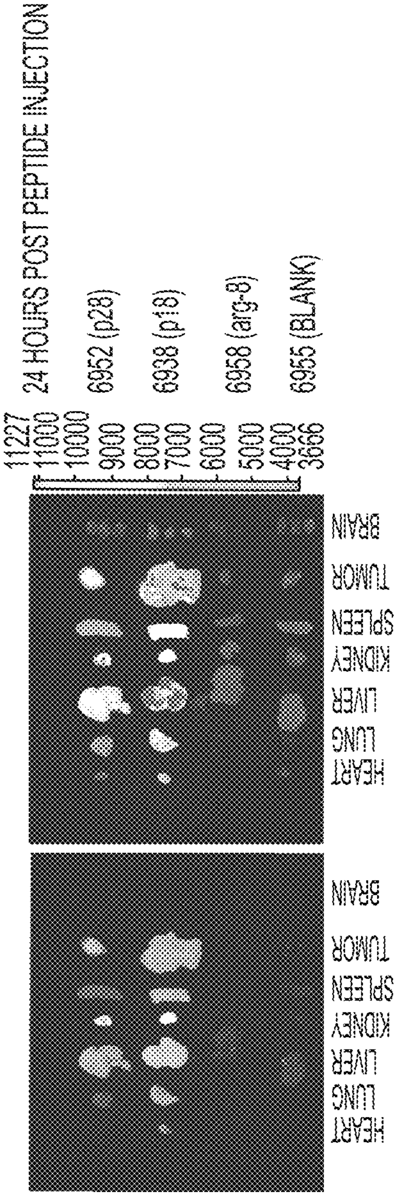

FIG. 43, (A) through (C). (A) Depicts side and back photographs of MEL-6 mice 3 hours after injection with 60 μM concentrations of p18 (SEQ ID NO: 14), p28 (SEQ ID NO: 13), and Arg-8 (SEQ ID NO: 3527). (B) Depicts side and back photographs of MEL-6 mice, and photographs of organs from MEL-6 mice, taken 22 hours after injection with 60 μM concentrations of p18 (SEQ ID NO: 14), p28 (SEQ ID NO: 13), and Arg-8 (SEQ ID NO: 3527). (C) Depicts photographs of organs from MEL-6 mice 24 hours after injection with 60 μM concentrations of p18 (SEQ ID NO: 14), p28 (SEQ ID NO: 13), and Arg-8 (SEQ ID NO: 3527).

Figure 44A:
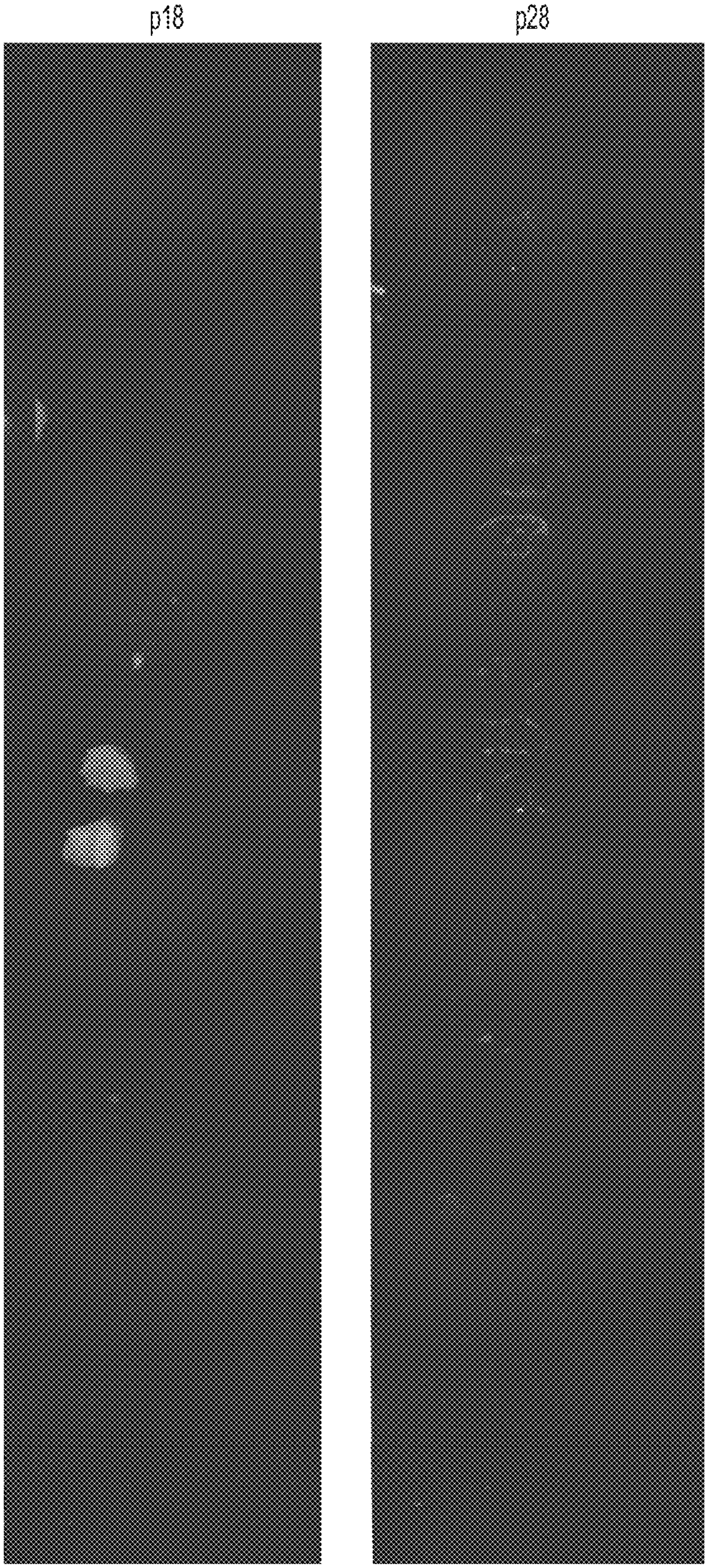
Figure 44B:
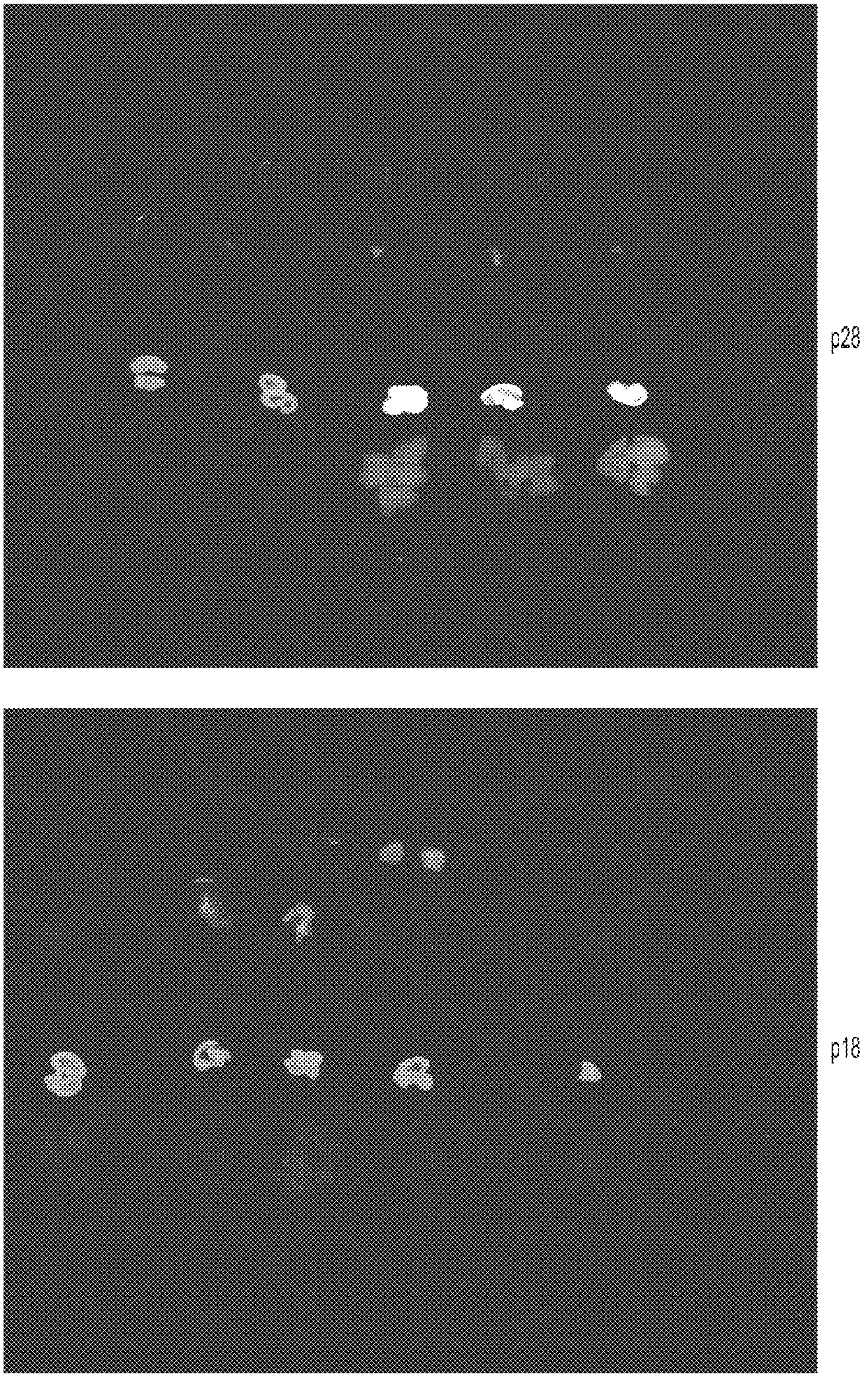

FIG. 44, (A) and (B). Depict uptake of p18 (SEQ ID NO: 14) and p28 (SEQ ID NO: 13) into (A) mouse brains and (B) mouse organs).

Figure 45:
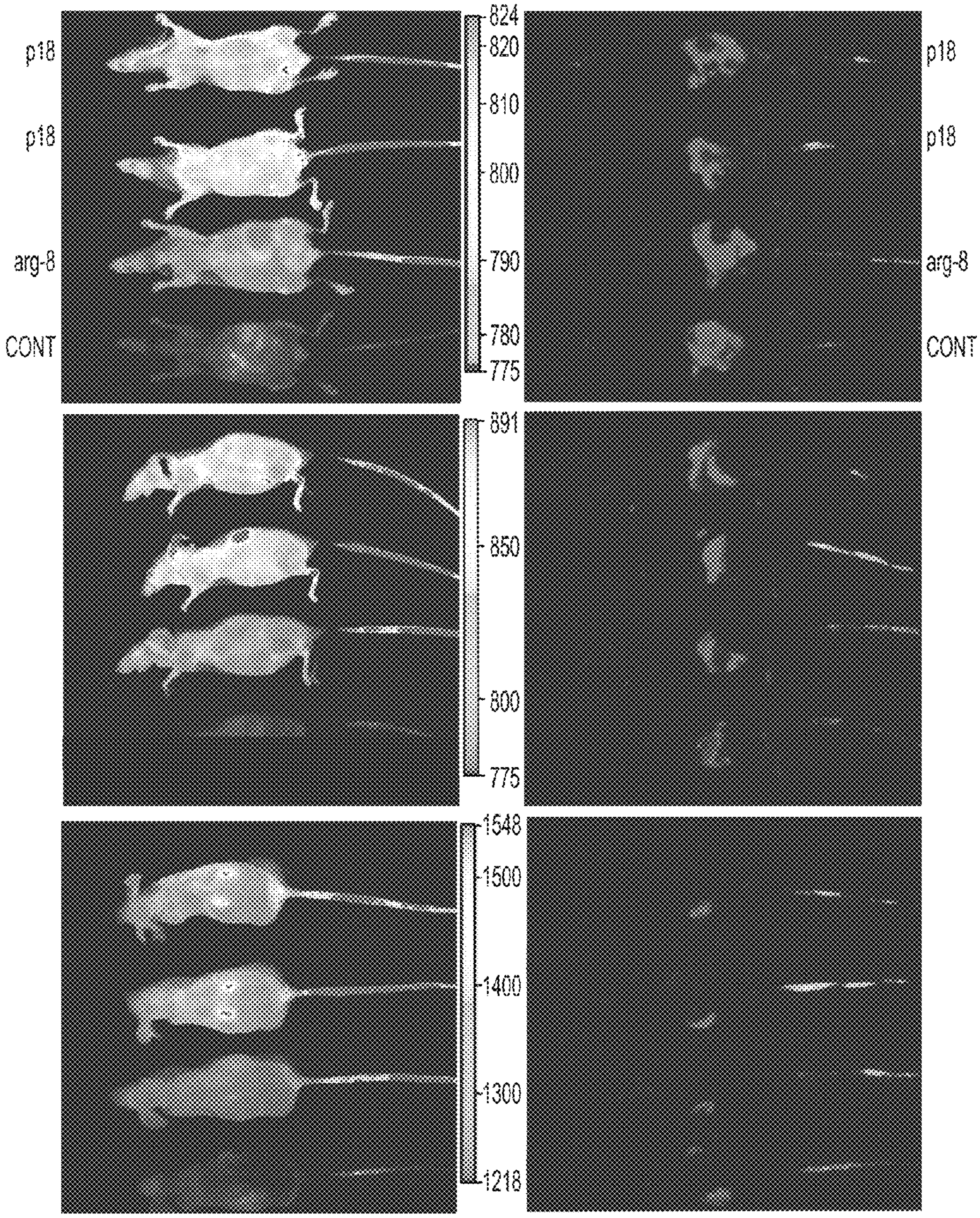

FIG. 45. Depicts side and back photographs of MEL-6 mice in study whereby 0.5 million cells injected I.V. into tail vein (44 days post), taken 120 hours after injection into tail vein of 24 μM concentrations of p18 (SEQ ID NO: 14) and Arg-8 (SEQ ID NO: 3527).

Figure 46:
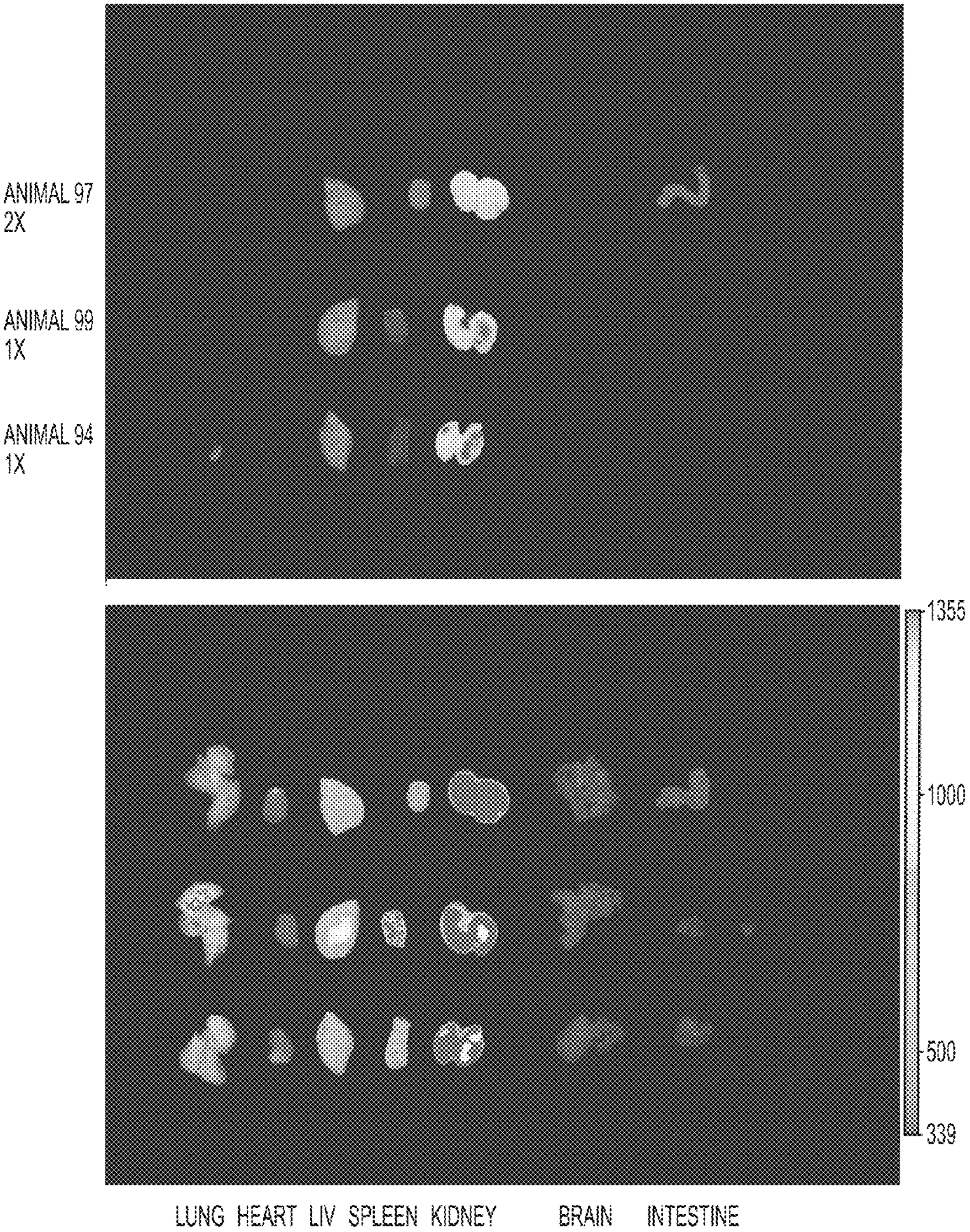

FIG. 46. Depicts photographs of organs from MEL-6 mice taken 168 hours after treatment with p18 (SEQ ID NO: 14).

Figure 47:
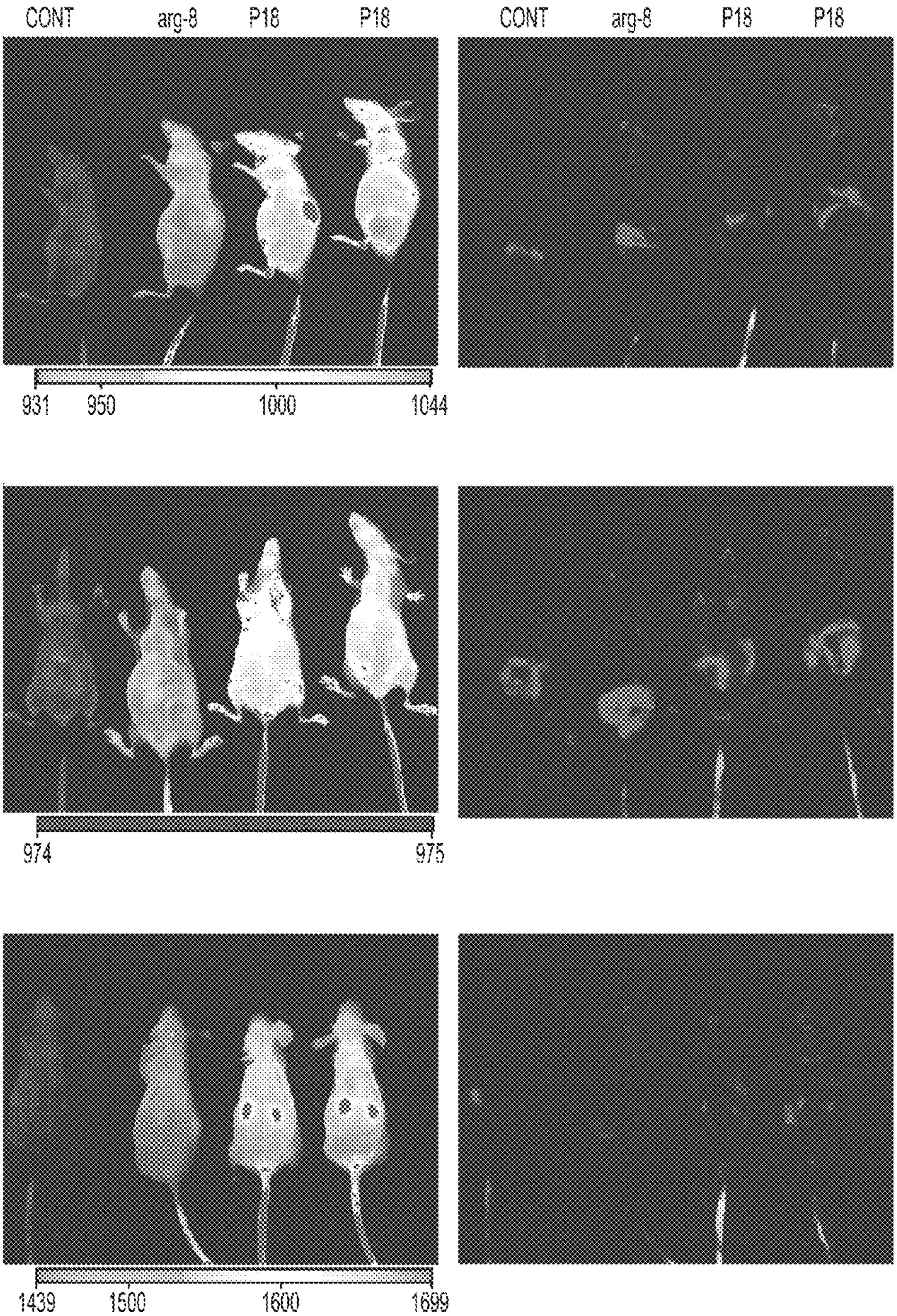

FIG. 47. Depicts side and back photographs of MEL-6 mice taken 72 hrs after injection of Arg-8 (SEQ ID NO: 3527) and p18 (SEQ ID NO: 14), 41 days post injection of cells.

Figure 48:
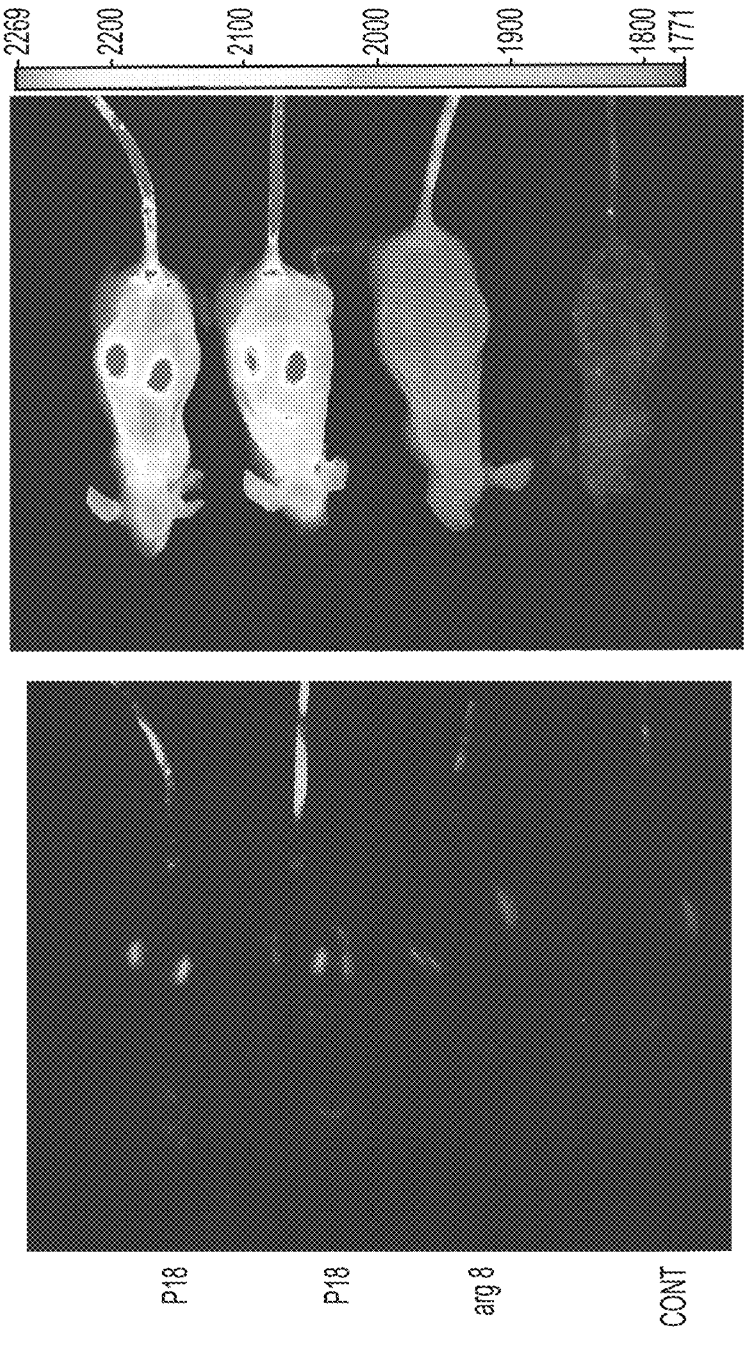

FIG. 48. Depicts back photographs of mice taken after injection of Arg-8 (SEQ ID NO: 3527) and p18 (SEQ ID NO: 14).

Figure 49:
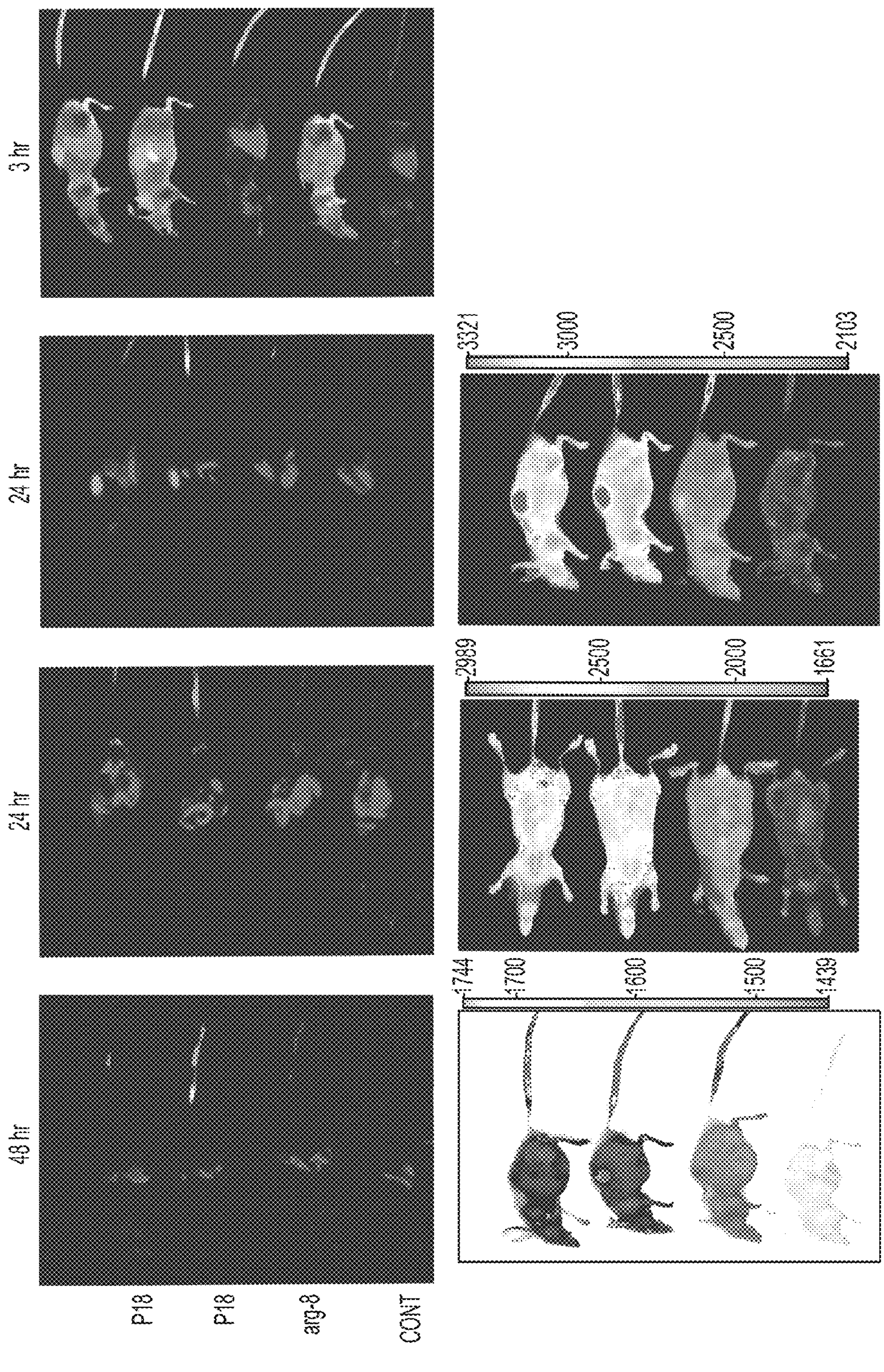

FIG. 49. Depicts side and front photographs of mice taken 3, 24, and 48 hours after injection of Arg-8 (SEQ ID NO: 3527) and p18 (SEQ ID NO: 14).

DETAILED DESCRIPTION OF THE EMBODIMENTS

Definitions

As used herein, the term "cell" includes both the singular or the plural of the term, unless specifically described as a "single cell."

As used herein, the terms "polypeptide," "peptide," and "protein" are used interchangeably to refer to a polymer of amino acid residues. The terms apply to amino acid polymers in which one or more amino acid residues are an artificial chemical analogue of a corresponding naturally occurring amino acid. The terms also apply to naturally occurring amino acid polymers. The terms "polypeptide," "peptide," and "protein" are also inclusive of modifications including, but not limited to, glycosylation, lipid attachment, sulfation, gamma-carboxylation of glutamic acid residues, hydroxylation and ADP-ribosylation. It will be appreciated that polypeptides are not always entirely linear. For instance, polypeptides may be branched as a result of ubiquitination and they may be circular (with or without branching), generally as a result of post-translation events, including natural processing event and events brought about by human manipulation which do not occur naturally. Circular, branched and branched circular polypeptides may be synthesized by non-translation natural process and by entirely synthetic methods as well. A synthetic peptide is one made without the aid of cellular components. Synthetic methods to make peptides are well known in the art and are commercially available. Further, this invention contemplates the use of both the methionine-containing and the methionine-less amino terminal variants of the protein of the invention.

As used herein, the term "condition" includes anatomic and physiological deviations from the normal that constitute an impairment of the normal state of the living animal or one of its parts, that interrupts or modifies the performance of the bodily functions.

As used herein, the term "inhibit cell growth" means the slowing or ceasing of cell division and/or cell expansion. This term also includes the inhibition of cell development or increases in cell death.

As used herein, the term "suffering from" includes presently exhibiting the symptoms of a condition, having a condition even without observable symptoms, in recovery from a condition, and recovered from a condition.

A used herein, the term "treatment" includes preventing, lowering, stopping, or reversing the progression or severity of the condition or symptoms associated with a condition being treated. As such, the term "treatment" includes medical, therapeutic, and/or prophylactic administration, as appropriate.

A "therapeutically effective amount" is an amount effective to prevent, lower, stop or reverse the development of, or to partially or totally alleviate a particular condition, or the existing symptoms of a particular condition for which the subject being treated. Determination of a therapeutically effective amount is well within the capability of those skilled in the art.

As used herein, the term "pharmacologic activity" means the effect of a drug or other chemical on a biological system. The effect of chemical may be beneficial (therapeutic) or harmful (toxic). The pure chemicals or mixtures may be of natural origin (plant, animal, or mineral) or may be synthetic compounds.

As used herein, the term "premalignant" means precancerous, or before abnormal cells divide without control.

As used herein, the term "pharmacokinetic property" refers to a parameter that describes the disposition of an active agent or drug in an organism or host. Representative pharmacokinetic properties include: plasma half-life, hepatic first-pass metabolism, volume of distribution, degree of blood serum protein, e.g. albumin, binding, etc.

As used herein, the term "plasma half-life" refers to the time for one-half of an administered drug to be eliminated from the plasma of the patient through biological processes, e.g., biometabolism, excretion, etc.

As used herein, the term "volume of distribution" refers to the distribution and degree of retention of a drug throughout the various compartments of an organisms, e.g. intracellular and extracellular spaces, tissues and organs, etc. This factor is expressed as the "apparent volume of distribution," or $V_d$, which is the estimated volume of the body into which the drug has distributed. A large Vd suggests that the drug has distributed more broadly throughout the body and may be associated with the longer half-life because a lesser portion of the drug will be in the plasma and thus delivered to the elimination points, the kidney and the liver.

As used herein, the term "degree of blood serum binding" refers to the propensity of a drug to be bound by a blood serum protein, such as albumin.

As used herein, the term "efficacy" refers to the effectiveness of a particular active agent for its intended purpose, i.e. the ability of a given active agent to cause its desired pharmacologic effect.

As used herein, the term "specific activity" refers to the amount of product formed by an enzyme in a given amount of time under given conditions per milligram of enzyme. Specific activity is equal to the rate of reaction multiplied by the volume of reaction divided by the mass of enzyme. In the case of a transport peptide, the specific activity will be the amount of transport peptide or transport peptide-cargo complex internalized into a cell in a given amount of time under given conditions per milligram of transport peptide or transport peptide-cargo complex.

The term "substantially pure," as used herein, when used to modify a protein or other cellular product of the invention, refers to, for example, a protein isolated from the growth medium or cellular contents, in a form substantially free of, or unadulterated by, other proteins and/or active inhibitory compounds. The term "substantially pure" refers to a factor in an amount of at least about 75%, by dry weight, of isolated fraction, or at least "75% substantially pure." More specifically, the term "substantially pure" refers to a compound of at least about 85%, by dry weight, active compound, or at least "85% substantially pure." Most specifically, the term "substantially pure" refers to a compound of at least about 95%, by dry weight, active compound, or at least "95% substantially pure." The term "substantially pure" may also be used to modify a synthetically made protein or compound, where, for example, the synthetic protein is isolated from the reagents and by-products of the synthesis reaction(s).

The term "pharmaceutical grade," as used herein, when referring to a peptide or compound of the invention, is a peptide or compound that is isolated substantially or essentially from components which normally accompany the material as it is found in its natural state, including synthesis reagents and by-products, and substantially or essentially isolated from components that would impair its use as a pharmaceutical. For example, a "pharmaceutical grade" peptide may be a isolated away from any carcinogen. In some instances, "pharmaceutical grade" may be modified by the intended method of administration, such as "intravenous pharmaceutical grade," in order to specify a peptide or compound that is substantially or essentially isolated from any substance that would render the composition unsuitable for intravenous administration to a patient. For example, an "intravenous pharmaceutical grade" peptide may be isolated from detergents, such as SDS, and anti-bacterial agents, such as azide.

The phrases "isolated," "purified" or "biologically pure" refer to material which is substantially or essentially free from components which normally accompany the material as it is found in its native state. Thus, isolated peptides in accordance with the invention preferably do not contain materials normally associated with the peptides in their in situ environment. An "isolated" region refers to a region that does not include the whole sequence of the polypeptide from which the region was derived. An "isolated" nucleic acid, protein, or respective fragment thereof has been substantially removed from its in vivo environment so that it may be manipulated by the skilled artisan, such as but not limited to nucleotide sequencing, restriction digestion, site-directed mutagenesis, and subcloning into expression vectors for a nucleic acid fragment as well as obtaining the protein or protein fragment in substantially pure quantities.

The term "wild-type," as used herein to refer to a peptide, mean that the peptide has the same sequence as one naturally occurring.

The term "variant" as used herein with respect to a peptide, refers to amino acid sequence variants that may have amino acids replaced, deleted, or inserted as compared to the wild-type polypeptide. Variants may be truncations of the wild-type peptide. A "deletion" is the removal of one or more amino acids from within the wild-type protein, while a "truncation" is the removal of one or more amino acids from one or more ends of the wild-type protein. Thus, a variant peptide may be made by manipulation of genes encoding the polypeptide. A variant may be made by altering the basic composition or characteristics of the polypeptide, but not at least some of its fundamental pharmacologic activities. For example, a "variant" of the *Pseudomonas aeruginosa* transit peptide may be a mutated *Pseudomonas aeruginosa* transit peptide that retains its ability to enter cancer cells. In some cases, a variant peptide is synthesized with non-natural amino acids, such as $\epsilon$-(3,5-dinitrobenzoyl)-Lys residues. (Ghadiri & Fernholz, J. Am. Chem. Soc., 112:9633-9635 (1990)). In some embodiments, the variant has not more than 20, 19, 18, 17 or 16 amino acids replaced, deleted or inserted compared to wild-type peptide or a portion thereof. In some embodiments, the variant has not more than 15, 14, 13, 12 or 11 amino acids replaced, deleted or inserted compared to wild-type peptide or a portion thereof. In some embodiments, the variant has not more than 10, 9, 8 or 7 amino acids replaced, deleted or inserted compared to wild-type peptide or a portion thereof. In some embodiments, the variant has not more than 6 amino acids replaced, deleted or inserted compared to wild-type peptide or a portion thereof. In some embodiments, the variant has not more than 5 or 4 amino acids replaced, deleted or inserted compared to wild-type peptide or a portion thereof. In some embodiments, the variant has not more than 3, 2 or 1 amino acids replaced, deleted or inserted compared to wild-type peptide or a portion thereof.

The term "amino acid," as used herein, means an amino acid moiety that comprises any naturally-occurring or non-naturally occurring or synthetic amino acid residue, i.e., any moiety comprising at least one carboxyl and at least one amino residue directly linked by one, two, three or more carbon atoms, typically one ($\alpha$) carbon atom. An amino acid may be an L-isomer or a D-isomer of an amino acid.

The term "modified residue" as used herein refers to an amino acid that has been modified using a method or technique which may include, but is not limited to, one or more of the methods and techniques disclosed herein.

The term "derivative" as used herein with respect to a peptide refers to a peptide that is derived from the subject peptide. A derivation includes chemical modifications of the peptide such that the peptide still retains some of its fundamental pharmacologic activities. For example, a "derivative" of a *Pseudomonas aeruginosa* transport peptide can be a chemically modified *Pseudomonas aeruginosa* transport peptide that retains its ability to enter cancer cells. Chemical modifications of interest include, but are not limited to, amidation, acetylation, sulfation, polyethylene glycol (PEG) modification, phosphorylation or glycosylation of the peptide. In addition, a derivative peptide maybe a fusion of a polypeptide to a chemical compound, such as, but not limited to, another peptide, drug molecule or other therapeutic or pharmaceutical agent or a detectable probe.

The term "percent (%) amino acid sequence identity" is defined as the percentage of amino acid residues in a polypeptide that are identical with amino acid residues in a candidate sequence when the two sequences are aligned. To determine % amino acid identity, sequences are aligned and if necessary, gaps are introduced to achieve the maximum % sequence identity; conservative substitutions are not considered as part of the sequence identity. Amino acid sequence alignment procedures to determine percent identity are well known to those of skill in the art. Often publicly available computer software such as BLAST, BLAST2, ALIGN2 or Megalign (DNASTAR) software is used to align peptide sequences. In a specific embodiment, Blastp (available from the National Center for Biotechnology Information, Bethesda Md.) is used using the default parameters of long complexity filter, expect 10, word size 3, existence 11 and extension 1.

When amino acid sequences are aligned, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) can be calculated as:

$$\%\ \text{amino acid sequence identity} = X/Y*100$$

where

X is the number of amino acid residues scored as identical matches by the sequence alignment program's or algorithm's alignment of A and B and Y is the total number of amino acid residues in B.

If the length of amino acid sequence A is not equal to the length of amino acid sequence B, the % amino acid sequence identity of A to B will not equal the % amino acid sequence identity of B to A. When comparing longer sequences to shorter sequences, the shorter sequence will be the "B" sequence. For example, when comparing truncated peptides to the corresponding wild-type polypeptide, the truncated peptide will be the "B" sequence.

General

The present invention relates to cupredoxin derived peptides that maintain one or more pharmacologic activities of the cupredoxin and which may have improved pharmacokinetic properties, such as improved stability, specific activity, half-life in the bloodstream, and/or decreased immunogenicity, among others. Additionally, the present invention relates to compounds derived from the modified cupredoxin derived peptides, which in turn also maintain one or more pharmacologic activities of the cupredoxin and which have improved pharmacokinetic properties. Finally, the invention relates to methods to use the modified cupredoxin derived peptides and compound made from them to treat and/or diagnose various conditions suffered by mammalian patients, and to research various conditions suffered by mammalian patients. The Sequence Listing submitted herewith is incorporated by reference in its entirety herein.

Compositions

The invention relates to peptides that are modifications of cupredoxin derived peptides. In some embodiments the modified peptides have improved pharmacokinetic properties. In some embodiments, these modified cupredoxin derived peptides retain at least one pharmacologic activity of the cupredoxin. In some embodiments, the modified cupredoxin derived peptides are isolated, substantially pure, or pharmaceutical grade. In specific embodiments, the modified cupredoxin derived peptides are intravenous pharmaceutical grade.

Cupredoxins, and specifically azurin from *Pseudomonas aeruginosa*, are known to have several useful pharmacologic activities that are useful for treating and/or diagnosing mammalian patients, and for conducting research on conditions suffered by mammalian patients. For example, many cupredoxin proteins, such as *Pseudomonas aeruginosa* azurin, have the ability to specifically enter and kill many types of mammalian cancer cells. Yamada et al., Cell. Biol. 7:1418-1431 (2005); Hiraoka et al., PNAS 101:6427-6432 (2004); Hiraoka et al., Biochem. Biophys. Res. Comm. 338:1284-1290 (2005); U.S. patent application Ser. No. 11/244,105, filed Oct. 6, 2005; U.S. patent application Ser. No. 10/720,603, filed Nov. 24, 2003; U.S. patent application Ser. No. 10/047,710, filed Jan. 15, 2002; U.S. patent application Ser. No. 11/485,252, filed Jul. 13, 2006, all of which are expressly incorporated herein by reference in their entirety. Azurin from *P. aeruginosa* is also known to inhibit the growth of viral or bacterial infection, and more specifically HIV-1 infection in peripheral blood mononuclear cells and also to inhibit parasitemia of malaria-infected mammalian red blood cells. Chaudhari et al., Cell Cycle. 5:1642-1648 (2006); U.S. patent application Ser. No. 11/436,591, filed May 19, 2006; U.S. patent application Ser. No. 11/436,590, filed May 19, 2006, both of which are expressly incorporated herein by reference in their entirety. Azurin from *P. aeruginosa* is also known to interfere with the ephrin signaling system in various mammalian cells and tissues. U.S. patent application Ser. No. 11/436,592, filed May 19, 2006, which is expressly incorporated herein by reference in its entirety. Further, peptides derived from *P. aeruginosa* azurin are known to inhibit angiogenesis in mammalian cells, and specifically human umbilical vascular endothelium cells (HUVECs). U.S. patent application Ser. No. 11/488,693, filed Jul. 19, 2006, which is expressly incorporated herein by reference in its entirety. In some embodiments, the modified cupredoxin derived peptides of the invention retain at least one pharmacologic activity of the cupredoxin from which they are derived. The pharmacologic activity of cupredoxin may be any useful activity of a cupredoxin. Pharmacologic activities of particular interest include, but are not limited to, the ability to specifically enter mammalian cancer cells, the inability to enter non-cancerous mammalian cells, the ability to enter pre-malignant mammalian cells, the ability to kill mammalian cancer cells, the ability to kill pre-malignant mammalian cells, the ability to inhibit the growth of viral or bacterial infection, the ability to inhibit the HIV-1 infection in peripheral blood mononuclear cells, the ability to inhibit parasitemia by malaria in malaria-infected red blood cells, and the ability to inhibit angiogenesis in mammalian cells, and specifically HUVECs. Methods to measure the amount of pharmacologic activity of the peptide are provided in the above referenced applications and publications.

Azurin, a cupredoxin from *Pseudomonas aeruginosa*, utilizes a protein transduction domain (PTD) to selectively enter human cancer cells. The minimal motif PTD used by these cupredoxins had not been previously identified. The mechanisms of entry by azurin, p18 (SEQ ID 14) and p28 (SEQ ID 13) are detailed here and in the examples provided below. Generally, PTDs cluster into two groups based on their structural characteristics, cationic residues or amphipathic α-helix, although several fall into both classes. In general, cationic peptides initially interact with the cell membranes of prokaryotic and eukaryotic species by binding to negatively charged surface glycoproteins, facilitating efficient entry into a broad range of normal and malignant cell lines. Kondejewski, L. H., et al, J Biol Chem 277: 67-74 (2002); Fuchs, S. M. and Raines, R. T., Biochemistry, 43: 2438-2444 (2004). The binding of cationic peptides to HS is consistent with their high affinity for HS (Kd −109 nM), a value well in excess of that reported for azurin, p18 (SEQ ID 14) and p28 (SEQ ID 13). Tran, D. et al, Proc Natl Acad Sci USA 84: 7957-7961 (1987).

However, the cytotoxic effects exerted by synthetic, cationic, amphipathic α-helical diastereomeric peptides are not generally specific to cancer cells. Amphipathic cell penetrating peptides (CPPs) that are cytolytic to cancer cells either disrupt the cancer cell membrane, alter mitochondrial permeability, or act through a specific receptor mediated mechanism. Leuschner, C. and Hansel, W., Curr Pharm Des, 10: 2299-2310 (2004). Synthetic magainins, a linear, helical, channel-forming or ionophore class of peptides including those exclusively comprised of Lys, Ala, and Leu residues rapidly and irreversibly lyse hematopoietic and solid tumor target cells at doses below those cytotoxic to normal cells, but do not have the property of preferentially penetrating cancer cells. Javapour, M. M., et al., J Med Chem, 39: 3107-3113 (1996); Cruciani, R. A., et al., Proc Natl Acad Sci USA 88: 3792-3796 (1991); Papo, N. and Shai, Y., Biochemistry, 42: 9346-9354 (2003). Peptides generated through phage-display technology, though rather specific for lymphatic and tumor blood vessels, also do not induce cytotoxicity by direct penetration of cancer cells.

In contrast, azurin and the two peptides derived from it (p28, SEQ. ID 13, and p18, SEQ. ID 14) possess the unique property of preferentially entering cancer cells and inhibiting their proliferation through cytostatic and cytotoxic mechanisms. It has been shown by confocal microscopy and FACS that p18 (SEQ. ID 14) is the minimal motif responsible for azurin's preferential entry into human cancer cells.

In addition to entering cancer cells, p18 (SEQ ID NO: 14) and p28 (SEQ ID NO: 13) are able to enter tumors and mammalian organs, as is shown in FIGS. 14 through 49, which were obtained using the methods disclosed in Example 9. Surprisingly, p18 (SEQ ID NO: 14) and p28 (SEQ ID NO: 13) are also able to penetrate the blood-brain barrier and enter mammalian brains, as demonstrated by, for example, FIGS. 16A, 16B, 17B, 19, 20, 24, 26, 27A, 28B, 29, 30B, 31A-B, 33A-C, 34A-C, 36A, 38A, 39A, 41A-D, 42, 43B, 44A-B, and 46.

Redox proteins, such as azurin, are not normally classified as CPPs, or anti-proliferative agents. The amphipathic, azurin fragments p18 (SEQ ID NO: 14) and p28 (SEQ ID NO: 13) contain the 54-67 amino acid α-helical structure of azurin as well as a partial α-sheet structure and describe a minimal sequence for cancer cell entry and cell cycle inhibitory activity, respectively. The entry of azurin, p28 (SEQ ID NO: 13), and p18 (SEQ ID NO: 14) is distinct from that of cationic CPPs. Aberrant N-glycosylation on several cell surface receptors, including integrins and cadherins, is associated with changes in progression and metastasis of cancers of diverse histogenesis, suggesting a role for as yet unknown N-glycoslyated cell surface protein(s) in the initial steps of azurin, p18 (SEQ ID NO: 14) and p28 (SEQ ID NO: 13) penetration. Partridge, E. A., et al, Science 306: 120-124 (2004); Seales, E. C., et al., Cancer Res 65:4645-4652 (2005).

The temperature dependent entry of cationic CPPs, which supports an endocytotic component to cell penetration, is reflected in the entry of azurin and amino acid fragment 50-77 (p28 SEQ. ID 13). Yamada, T., et al., Cell Microbiol 7: 1418-1431 (2005). The entry of amino acids 50-67 of azurin (p18 SEQ. ID 14) into normal and malignant cells appears accelerated relative to p28 (SEQ ID NO: 13). The lower $K_m$ and higher $V_{max}$ of p18 (SEQ ID NO: 14) suggest that amino acids 50-67 define an amphipathic structure when associated with phospholipid membranes that more closely represents the actual PTD of azurin. However, an energy dependent endocytotic or pore related process does not appear to be the only entry mechanism available to these peptides. For example, the metabolic and membrane potential inhibitors sodium azide and ouabain (Na+ K+ ATPase inhibitor), which inhibit the entry-of cationic peptides, did not impair the entry of either p18 (SEQ ID NO: 14) or p28 (SEQ ID NO: 13) into UISO-Mel-2 cells or fibroblasts (FIG. 10 B,C), suggesting that either peptide may penetrate the cell membrane directly.

p18 (SEQ ID NO: 14), p28 (SEQ ID NO: 13) and azurin penetrate the plasma membrane and reach late endosmes, lysosomes and the golgi associated with caveolae in what is thought to be a dynamin-independent clathrinin dependent carrier mediated manner. Kirkham, M. and Parton, R. G., Biochem Biophys Acta 1746: 349-363 (2005). Nocodazole, which disrupts caveolae transport and caveolae-mediated endocytosis inhibited penetration by 50-65%. The striking inhibition of penetration by nocodazole and relative lack of inhibition by cytochalasin-D, which disrupts actin filaments, supports caveolae mediated entry. Notably, the lack of effect of staurosporine demonstrates that dynamin does not play a large role in the penetration of either peptide. Id. This route of entry has been described for integral cell surface components and seemingly disparate molecules, i.e., dextran, and a broad range of pathogens or their products that also utilize caveolae to bypass classic endocytotic pathways. Depletion of cholesterol from the plasma membrane with β-methylcylodextran, filipin or nystatin to disrupt lipid rafts, plasma membrane domains that provide fluid platforms to segregate membrane components and compartmentalize membranes, significantly inhibited the penetration of p18 (SEQ ID NO: 14) (50%) and p28 (SEQ ID NO: 13) (~60%) into UISO-Mel-2 cells and fibroblasts (35% and 42%, respectively) demonstrating that a significant percentage (~60%) of p18 (SEQ ID NO: 14) and p28 (SEQ ID NO: 13) penetrates the plasma membrane via caveolae. Caveolae are a 50-to 100-nm omega-shaped subset of lipid raft invaginations of the plasma membrane defined by the presence of caveolin specific proteins (caveolin-1, -2, or -3) that function as regulators of signal transduction.

Brefeldin A disrupts the Golgi apparatus and inhibited p18 (SEQ ID NO: 14) accumulation, so it follows that this pathway is also utilized in p18 (SEQ ID NO: 14) and p28 (SEQ ID NO: 13) entry and intracellular transport. Cell penetration of p18 (SEQ ID NO: 14) and p28 (SEQ ID NO: 13) via caveolae comports with the evidence that inhibitors of N-glycosylation reduce cell entry by ~60% in UISO-Mel-2 cells and 25% and 35% respectively in fibroblasts. The percentile differences between p18 (SEQ ID NO: 14) and p28 (SEQ ID NO: 13) entry relate to the numbers of N-glycosylation membrane structures in cancer vs. normal cells and the relative route of entry of p28 (SEQ ID NO: 13) and p18 (SEQ ID NO: 14) via this mechanism.

Azurin, p28 (SEQ ID NO: 13), and p18 (SEQ ID NO: 14) all bind to cancer cells with high affinity and high capacity relative to many other potential anti-cancer peptides. After binding, this protein/receptor complex localizes in caveolae and is internalized, eventually moving (via caveosomes) to the golgi, ER, and nucleus. In addition to caveolar-mediated entry, kinetic analysis also demonstrates that p28 (SEQ ID NO: 13) and p18 (SEQ ID NO: 14) penetrate the plasma membrane via a non-clathrin caveolae mediated process. A clathrin-and caveolin-independent pathway can exist as a constitutive internalization mechanism, such as for the interleukin 2 receptor and for certain glycosyl-phosphatidylinositol (GPI)-anchored proteins. Lamaze, C., et al., Mol Cell 7: 661-671 (2001); Sabharanjak, S., et al., Dev Cell, 2: 411-423 (2002). Clathrin-and caveolin-independent endocytosis is also used by pathogens to invade cells, either exclusively, as for the murine polyoma virus, or in combination with a conventional pathway, as is the case for the influenza virus. Ewers, H., et al, Proc Natl Acad Sci USA 102: 15110-15115 (2005); Sieczkarski, S. B. and Whittaker, G. R., J Virol, 76:10455-10464 (2002). An increase in caveolin-1 expression in cancer cells over normal cells is not likely to be the sole basis for the preferential entry of azurin, p28 (SEQ ID NO: 13) and p18 (SEQ ID NO: 14) into cancer cells. Fibroblasts and a number of other normal cells also have significant numbers of caveolae on their surface.

p18 (amino acids 50-67 of azurin, SEQ. ID 14) and p28 (amino acids 50-77 of azurin, SEQ. ID 13) are not bound by cell membrane glycosaminoglycans and preferentially penetrate cancer cells via endocytotic, caveosome directed and caveosome independent pathways. The cellular penetration of p18 (SEQ ID NO: 14) and p28 (SEQ ID NO: 13) is unique relative to all current CPPs in its preference for cancer cells. Surprisingly, the C-terminal 10-12 amino acids of p28 (SEQ ID NO: 13) are demonstrated to comprise the domain responsible for cell cycle inhibition and apoptotic activity/cytotoxicity. Furthermore, this same domain is most likely to contact specific residues on a cell membrane and thus facilitate entry; amino acids 69, 70, 75, 76, and 85 of azurin in particular provide contact to the cell membrane. Once internalized, p28 (SEQ ID NO: 13) inhibits cancer cell proliferation initially through a cytostatic mechanism. Thus, it is now known that p18 (SEQ ID NO: 14) and p28 (SEQ ID NO: 13) account for the preferential entry of azurin into human cancer cells and a significant amount of the anti-proliferative activity of azurin on human cancer cells, respectively.

The cupredoxin derived peptides may be any cupredoxin, or variant, derivative or structural equivalent of cupredoxin, or a truncation thereof. In some embodiments, the cupredoxin derived peptide retains at least one pharmacologic activity of the cupredoxin. In some embodiments, the cupredoxin may be, but is not limited to, azurin, plastocyanin, rusticyanin, pseudoazurin, auracyanin or azurin-like protein. The cupredoxin derived peptides may be from any organism, including but not limited to *Pseudomonas aeruginosa, Phormidium laminosum, Thiobacillus ferrooxidans, Achromobacter cycloclastes, Pseudomonas syringa, Neisseria meningitidis, Vibrio parahaemolyticus, Bordetella bronchiseptica, Bordetella pertussis, Chloroflexus aurantiacus* and *Neisseria gonorrhoeae*. In some embodiments, the cupredoxin may be azurin, specifically from an organism including but not limited to *Pseudomonas aeruginosa, Pseudomonas syringae. Neisseria gonorrhoeae, Vibrio parahaemolyticus*, or *Bordetella bronchiseptica*.

The cupredoxin derived peptides may be any variant, derivative or structural equivalent of a cupredoxin. In some embodiments, the cupredoxin derived peptides may be a truncation of a cupredoxin. The cupredoxin derived peptides may also be any cupredoxin peptide that is known in the art and/or described in previous applications, such as U.S. patent application Ser. No. 11/244,105, filed Oct. 6, 2005; U.S. patent application Ser. No. 10/720,603, filed Nov. 24, 2003; U.S. patent application Ser. No. 10/047,710, filed Jan. 15, 2002, now U.S. Pat. No. 7,084,105; U.S. patent application Ser. No. 11/485,252, filed Jul. 13, 2006; U.S. patent application Ser. No. 11/436,591, filed May 19, 2006; U.S. patent application Ser. No. 11/436,590, filed May 19, 2006; U.S. patent application Ser. No. 11/436,592, filed May 19, 2006; and U.S. patent application Ser. No. 11/488,693, filed Jul. 19, 2006. All of these applications are expressly incorporated by reference herein in their entirety. In some embodiments, the peptide is isolated. In some embodiments, the peptide is substantially pure or pharmaceutical grade. In other embodiments, the peptide is in a composition that comprises, or consists essentially of, the peptide. In another specific embodiment, the peptide does not raise an immune response in a mammal, and more specifically a human.

The cupredoxin derived peptides may be amino acid sequence variants which have amino acids replaced, deleted, or inserted as compared to the wild-type cupredoxin. These variants may be truncations of the wild-type cupredoxin. In some embodiments, amino acids may be replaced with unnatural or modified amino acids. An unnatural amino acid is one other than the 20 common amino acids. The cupredoxin derived peptides comprise a region of a cupredoxin that is less that the full length wild-type polypeptide. In some embodiments, the cupredoxin derived peptides comprise more than about 10 residues, more than about 15 residues or more than about 20 residues of a truncated cupredoxin. In some embodiments, the cupredoxin derived peptides comprise not more than about 100 residues, not more than about 50 residues, not more than about 40 residues, not more than about 30 residues or not more than about 20 residues of a truncated cupredoxin. In some embodiments, a cupredoxin has to the cupredoxin derived peptide, and more specifically SEQ ID NOS: 1-12 at least about 70% amino acid sequence identity, at least about 80% amino acid sequence identity, at least about 90% amino acid sequence identity, at least about 95% amino acid sequence identity or at least about 99% amino acid sequence identity.

In specific embodiments, the cupredoxin derived peptide comprises *P. aeruginosa* azurin residues 50-77 (SEQ ID NO:13), azurin residues 50-67 (SEQ ID NO: 14), or azurin residues 36-89 (SEQ ID NO: 16). In other embodiments, the variant of cupredoxin consists of *P. aeruginosa* azurin residues 50-77 (SEQ ID NO:13), azurin residues 50-67 (SEQ ID NO:14), or azurin residues 36-89 (SEQ ID NO: 16). In other specific embodiments, the variant consists of the equivalent residues of a cupredoxin other that azurin. To determine the equivalent residues of another cupredoxin, the subject cupredoxin amino acid sequence will be aligned to the *Pseudomonas aeruginosa* azurin sequence using BLAST, BLAST2, ALIGN2 or Megalign (DNASTAR), the relevant residues located on the *P. aeruginosa* azurin amino acid sequence, and the equivalent residues found on the subject cupredoxin sequence, and the equivalent peptide thus designed.

In one embodiment of the invention, the cupredoxin derived peptide comprises at least amino acids 57 to 89 of auracyanin B of Chloroflexus aurantiacus (SEQ ID NO: 21). In another embodiment of the invention, the cupredoxin derived peptide comprises at least amino acids 51-77 of *Pseudomonas syringae* azurin (SEQ ID NO: 27). In another embodiment of the invention, the cupredoxin derived peptide comprises at least amino acids 89-115 of *Neisseria meningitidis* Laz (SEQ ID NO: 23). In another embodiment of the invention, the cupredoxin derived peptide comprises at least amino acids 52-78 of Vibrioparahaemolyticus azurin (SEQ ID NO: 28). In another embodiment of the invention, the cupredoxin derived peptide comprises at least amino acids 51-77 of *Bordetella bronchiseptica* azurin (SEQ ID NO: 29).

The cupredoxin derived peptides also include peptides made with synthetic amino acids that are not naturally occurring. For example, non-naturally occurring amino acids may be integrated into the variant peptide to extend or optimize the half-life of the composition in the bloodstream. Such variants include, but are not limited to, D,L-peptides (diastereomer), (see, for example Futaki et al., J. Biol. Chem. 276(8):5836-40 (2001); Papo et al., Cancer Res. 64(16):5779-86 (2004); Miller et al, Biochem. Pharmacol. 36(1):169-76, (1987); peptides containing unusual amino acids (see, for example Lee et al., J. Pept. Res. 63(2):69-84 (2004)), olefin-containing non-natural amino acid followed by hydrocarbon stapling (see, for example Schafmeister et al., J. Am. Chem. Soc. 122:5891-5892 (2000); Walenski et al., Science 305:1466-1470 (2004)), and peptides comprising ϵ-(3,5-dinitrobenzoyl)-Lys residues.

In other embodiments, the cupredoxin derived peptide is a derivative of a cupredoxin. The derivatives of cupredoxin are chemical modifications of the peptide such that the peptide still retains some of its fundamental pharmacologic activities. For example, a "derivative" of azurin can be a chemically modified azurin that retains its ability to inhibit the growth of mammalian cancer cells. Chemical modifications of interest include, but are not limited to, hydrocarbon stabling, amidation, acetylation, sulfation, polyethylene glycol (PEG) modification, phosphorylation and glycosylation of the peptide. In addition, a derivative peptide maybe a fusion of a cupredoxin, or variant, derivative or structural equivalent thereof to a chemical compound, such as but not limited to, another peptide, drug molecule or other therapeutic or pharmaceutical agent or a detectable probe. Derivatives of interest include chemical modifications by which the half-life in the bloodstream of the peptides and compositions of the invention can be extended or optimized, such as by several methods well known to those in the art, including but not limited to, circularized peptides (see, for example Monk et al., BioDrugs 19(4):261-78, (2005); DeFreest et al., J. Pept. Res. 63(5):409-19 (2004)), N-and C-terminal modifications (see, for example Labrie et al., Clin. Invest. Med. 13(5):275-8, (1990)), and olefin-containing non-natural amino acid followed by hydrocarbon stapling (see, for example Schafmeister et al., J. Am. Chem. Soc. 122:5891-5892 (2000); Walenski et al., Science 305: 1466-1470 (2004)).

In another embodiment, the peptide is a structural equivalent of a cupredoxin or a truncation of a cupredoxin. Examples of studies that determine significant structural homology between cupredoxins and other proteins include Toth et al. (Developmental Cell 1:82-92 (2001)). Specifically, significant structural homology between a cupredoxin and the structural equivalent is determined by using the VAST algorithm. Gibrat et al., Curr Opin Struct Biol 6:377-385 (1996); Madej et al., Proteins 23:356-3690 (1995). In specific embodiments, the VAST p value from a structural comparison of a cupredoxin to the structural equivalent is less than about $10^{-3}$, less than about $10^{-5}$, or less than about $10^{-7}$. In other embodiments, significant structural homology between a cupredoxin and the structural equivalent is determined by using the DALI algorithm. Holm & Sander, J. Mol. Biol. 233:123-138 (1993). In specific embodiments, the DALI Z score for a pairwise structural comparison is at least about 3.5, at least about 7.0, or at least about 10.0.

One specific cupredoxin derived peptide of interest is a fusion of the entry domain of cupredoxin with a cargo compound. In some embodiments, cupredoxin derived peptides may specifically enter into a mammalian cancer cell, and thus may be used to deliver a cargo compound into a cell, and specifically into a cancer cell. A cupredoxin transport peptide comprises a cupredoxin entry domain. The term "cupredoxin entry domain" refers to a fragment of a cupredoxin that includes the amino sequence that is required for the entry of cupredoxin into a mammalian cancer cell. In specific embodiments, the cupredoxin transport peptide is SEQ ID NOS: 13-17, or equivalent residues from another cupredoxin. The present invention encompasses cupredoxin transport peptides complexed with cargo compounds that have been modified to improve their pharmacokinetic properties. The cargo compound as well as the cupredoxin transport peptide may be modified by the methods described herein to improve pharmacokinetic properties. These complexes can then be used in the methods of the invention to deliver the cargo compound into mammalian cancer cells to treat patients suffering from cancer. Cargo compounds delivered by the materials and methods of the present invention include, but are not limited to, proteins, lipoproteins, polypeptides, peptides, polysaccharides, nucleic acids, including anti-sense nucleic acids, dyes, fluorescent and radioactive tags, microparticles or nanoparticles, toxins, inorganic and organic molecules, metals, small molecules, and drugs. In some embodiments, the drugs and toxins kill tumor cells. Such cupredoxin transport peptides and complexes made with them are provided in U.S. patent application Ser. No. 11/244,105, filed Oct. 6, 2005, which is expressly incorporated herein by reference in its entirety.

In some embodiments, the fusion between the cargo compound and the cupredoxin derived peptide may be by a linkage that is selectively cleaved after entry of the fused peptide into the cell. In some embodiments, such a linkage improves the pharmacokinetic properties of the cupredoxin transport peptide-cargo compound complex. In some embodiments, the stability of the cupredoxin transport peptide-cargo compound complex in plasma is enhanced. In some embodiments, the linkage may be one that is selectively cleaved in the lysosomes of a mammalian cell. In other embodiments, the linkage may be one that is cleaved by cathespin B, a cysteine protease located in the lysosomes or extracellularly in proximity to cancerous or arthritic sites. In some such embodiments, the linkage is a Val-Cit linkage.

In another embodiment, the peptide is a cupredoxin, or variant, structural equivalent, or derivative thereof that is a conjugate of Pep42, a cyclic 13-mer oligopeptide, CTVALPGGYRVRVC (SEQ ID. NO: 3505) that specifically binds to glucose-regulated protein 78 (GRP78) and is internalized into cancer cells. The cupredoxin or variant, structural equivalent, or derivative of cupredoxin may be conjugated with Pep42 (SEQ ID. NO: 3505) pursuant to the synthesis methods disclosed in Yoneda et al., "A cell-penetrating peptidic GRP78 ligand for tumor cell-specific prodrug therapy," Bioorganic & Medicinal Chemistry Letters 18: 1632-1636 (2008), the disclosure of which is incorporated in its entirety herein.

In some embodiments the cupredoxin derived peptide may be attached to Pep42 (SEQ ID. NO: 3505). In some embodiments, Pep42 (SEQ ID. NO: 3505) may be further fused with a drug. It is believed that Pep42 (SEQ ID. NO: 3505) specifically binds to glucose regulated protein 78 (GRP78), which is overexpressed in cancer cells, and is specifically present on the cancer cell surface. Yoneda, et al., Bioorganic & Medicinal Chemistry Letters 18 1632-1636 (2008). Pep42 (SEQ ID. NO: 3505) is efficiently internalized through the GRP78 receptor. Thus, in some embodiments, a cupredoxin derived peptide—Pep42 fusion peptide may have enhanced specificity to cancer cells. In some such embodiments, the fusion between Pep42 (SEQ ID. NO: 3505) and the cupredoxin derived protein may be through a Val-Cit linkage, a cathespin B. In some embodiments, the Pep42-drug conjugate may be via a Val-Cit linkage. Pep42-drug conjugates containing cathepsin B-cleavable linkers are likely to be stable in the plasma and selectively release their drug specifically in the targeted tissue. In some embodiments of the invention, Pep42 (SEQ ID. NO: 3505) is linked to p-aminobenzylalcohol via an amidic bond, which is then attached to the drug or cupredoxin derived peptide via a carbonate or carbamate functionality. In such embodiments, the enzymatic cleavage within the cancer cell delivers an unmodified cupredoxin derived protein or drug inside the cell.

In some embodiments, the cupredoxin-derived peptide is conjugated with a nanoparticle, for example a noble metal such as gold or platinum, to create a hybrid system that can be used in therapeutic applications, diagnostics, and imaging.

In some embodiments, amino acids residues in the cupredoxin derived peptides that are conserved among cupredoxins with the desired pharmacologic activity are conserved in modified cupredoxin derived peptides with improved pharmacokinetic properties. For example, it is known that within the cupredoxin entry domain of *Pseudomonas aeruginosa* azurin, several residues are conserved among azurins and azurin-like proteins from several species, *Pseudomonas aeruginosa, Pseudomonas syringae. Neisseria gonorrhoeae, Vibrio* parahaemolyticus, and *Bordetella bronchiseptica*. Yamada et al., Cell. Microbiol. 7:1418-1431 (2005). In some embodiments, the cupredoxin derived peptide retains one or more amino acid residues corresponding to residues 62, 63, 69, 72, 74 and 77 *P. aeruginosa* azurin (SEQ ID NO: 1). In another embodiment, the cupredoxin peptide comprises a conserved amino acid sequence DGXXXXXDXXYXKXXD (SEQ ID NO: 46) or DGXXXXDXXYXKXXD (SEQ ID NO: 47) where D is aspartic acid, G is glycine, Y is tyrosine, K is lysine and X is any amino acid.

Modifications

The present invention relates to modifications of cupredoxin derived peptides that are variants or derivatives or truncations, and in specific embodiments, maintain one or more pharmacologic activities, and/or that improve the pharmacokinetic properties of the peptide. These modifications include, but are not limited to, variants and derivatives of the peptides that may increase their stability, specific activity, plasma half life, and/or decrease immunogenicity of the cupredoxin derived peptide, while retaining the ability of the cupredoxin to enter mammal cancer cells and/or inhibit the growth of mammalian cancer cells. Such variants include, but are not limited to, those which decrease the hydrolysis of the peptide, decrease the deamidation of the peptide, decrease the oxidation, decrease the immunogenicity and/or increase the structural stability of the peptide. It is contemplated that two or more of the modifications described herein may be combined in one modified cupredoxin derived peptide, as well as combinations of one or more modifications described herein with other modification to improve pharmacokinetic properties that are well know to those in the art. Many methods to design such variants and derivatives are well know in the art.

One method of chemically modifying a cupredoxin or cytochrome c551 or variant, derivative, truncation, or structural equivalent thereof may be to follow the steps taken to design an anti-HIV small protein, CCL-5 (RANTES) with improved pharmaceutical properties by, for example, hydrophobic N-terminal modification, total protein-polymer conjugate chemicals synthesis, coded and noncoded amino acid mutagenesis, peptide backbone engineering, and site-specific polymer attachment. Anti-HIV proteins can be designed by incorporating natural and unnatural amino acid residues into CCL-5 analogues baring polymer substituents at varying attachment positions. Studies indicate that in vitro anti-HIV activity of polymer-modified CCL-5 derivatives correlates with CCR-5 signaling, so changes to the peptide should not disrupt CCR-5 activity. See Miranda, et al., J. Am. Chem. Soc. 129: 13153-13159 (2007), the disclosure of which is incorporated in its entirety herein.

Biotransformation

One approach to improving the pharmacokinetic properties of the peptides is to create variants and derivatives of the cupredoxin derived peptides that are less susceptible to biotransformation. Biotransformation may decrease the pharmacologic activity of the peptide as well as increase the rate at which it is eliminated from the patient's body. One way of achieving this is to determine the amino acids and/or amino acid sequences that are most likely to be biotransformed and to replace these amino acids with ones that are not susceptible to that particular transformative process.

In some embodiments, the cupredoxin derived peptides may include unnatural amino acids or modified amino acids. In some embodiments, the introduction of certain unnatural amino acids enhances the pharmacokinetic properties of the cupredoxin derived peptide. Such introduction may be site-specific and may be done to avoid certain biochemical modifications in vivo. Exemplary unnatural amino acids include β-amino acids (e.g., b3 and b2), homo-amino acids, cyclic amino acids, aromatic amino acids, Pro and Pyr derivatives, 3-substituted Alanine derivatives, Glycine derivatives, Ring-substituted Phe and Tyr Derivatives, α,α disubstituted amino acids, Linear Core Amino Acids and Diamino Acids. Such unnatural amino acids may be incorporated into peptides by site directed modification, ribosomal translation, or by chemical synthesis of the peptide. Each of these methods may be applied in synthesizing cupredoxin derived peptides.

For example, modified cupredoxin derived peptides may be synthesized by the use of wild-type Aminoacyl-tRNA synthetases (AARSs) with unnatural amino acids building for the production of unnatural cupredoxin variants. See Hartman, et al., PLoS One, 2(10): e972 (2007); Miranda, et al., J. Am. Chem. Soc. 129: 13153-13159 (2007). The specificity of the ribosomal translation apparatus limits the diversity of unnatural amino acids that may be incorporated into peptides using ribosomal translation. Over ninety unnatural building blocks that are AARS substrates have been uncovered including side chain and backbone analogs. Hartman, et al., PLoS One, 2(10): e972 (2007). Over fifty unnatural amino acids may be incorporated into peptides with high efficiency using an all-enzymatic translation system, with peptides containing up to thirteen different unnatural amino acids. Hartman, et al., PLoS One, 2(10): e972 (2007). Unnatural amino acids include, but are not limited to, 4-fluoro-glutamates, 4-methyl analogs, L-threo-β aspartic acid, S-2-aminoethyl cysteine, trans-dehydro lysine, aza-leucine, L-canavanine, L-$N^G$-methyl arginine, $N^G$ hydroxy arginine, vinyl-L-NIO, DL-β-hydroxy norvaline, L-Glu y-methyl ester, L-Asp β-methyl ester, L-glutamic acid y-hydrazide, L-albizziine, L-theanine, β-2-thiazolyl-alanine, β-(1,2,4-triazol-3-yl-alanine), 3-fluoro tyrosine, 3-fluoro valine, 3-nitro tyrosine, 2-fluoro Phe, 2-thienyl Ala, β-methyl Phe, β-thienyl Ser, p-nitrophenylalanine, 3-(thianaphthen-3-yl)-L-alanine, L-quisqualic acid, ibotenic acid, DL-α-(2-thienyl)glycine, L-phenylglycine, 2-amino hex-5-ynoic acid, crotylglycine, L-norleucine, L-norvaline, L-ethionine, L-β-azidohomoalanine, 6,6,6,-trifluoronorleucine, 2-amino-4,4,4-trifluorobutyric acid, L-C-propargyl glycine, L-allyl glycine, β-Cyclopropyl alanine, photo-Met, 3-fluoro-valine, t-butyl-glycine, O-methyl-L-threonine, (2S, 3S)-2-amino-3-methoxybutanoic acid, 4-thia-isoleucine, L-cyclohexylglycine, 5',5',5'-trifluoro leucine, β-t-butyl-alanine, β-cyclopentyl alanine, photo-Leu, thiazolidine-2-carboxylic acid, thiazolidine-4-carboxylic acid, 3,4-dehydro proline, L-azetidine-2-carboxylic acid, 1-amino cyclopentanoic acid, 1-aminocyclohexanoic acid, β-hydroxy acids, N-methyl His, N-methyl Asp, α-hydroxy acids, and α-hydroxy methionine. The Hartmann and Miranda references, and all unnatural building blocks and amino acids described and disclosed by these references, are hereby incorporated by reference in their entirety herein. In some embodiments, such amino acids may be incorporated in cupredoxin derived peptides.

Other modifications may include the use of optically active α-amino acids. The use of optically active α-amino acids and their derivatives is being expanded for their use in pharmaceuticals, agrochemicals and as chiral ligands. In particular, chiral glycine and alanine equivalents plan an important role. At least one stereoselective strategy for constructing α-amino acids has been proposed, allowing for enantiopure α-amino acids in predetermined stereochemistry. Lu, et al. "Asymmetric Synthesis of α-amino acids: Preparation and alkylation of monocyclic iminolactones derived from α-Methyl trans-cinnamaldehyde" published on Internet on Sep. 11, 2008 (to be published in J. Org. Chem.). The modified cupredoxin derived peptides may be synthesized using the optically active α-amino acids to produce enantiomerically enriched iterations.

Hydrolysis is generally a problem in peptides containing aspartate. Aspartate is susceptible to dehydration to form a cyclic imide intermediate, causing the aspartate to be converted to the potentially inactive iso-aspartate analog, and ultimately cleaving the peptide chain. For example, in the presence of aspartic acid—proline in the peptide sequence, the acid catalyzed formation of cyclic imide intermediate can result to cleavage of the peptide chain. Similarly, in the presence of aspartic acid—glycine in the peptide sequence, the cyclic intermediate can be hydrolyzed either into the original aspartate form (harmless) or into the iso-aspartate analog. Eventually, all of the aspartate form can be completely converted into the iso-aspartate analog. Similarly sequences with serine can also be dehydrated to form a cyclic imide intermediate that can cleave the peptide chain. Cleavage of the peptide may result in reduced plasma half-life as well as reduced specific pharmacologic activity of the peptide.

It is contemplated that substituting other amino acids for asparagine and/or serine in the sequence of the cupredoxin derived peptide may result in a peptide with improved pharmacokinetic properties such as a longer plasma half-life and increased specific activity of a pharmacologic activity of the peptide. In one contemplated variant, at one or more asparagine residues of the cupredoxin derived peptide may be replaced with another amino acid residue, and specifically a glutamic acid residue. In another contemplated variant, one or more serine residues of the cupredoxin derived peptide may be replaced with another amino acid residue, and specifically a threonine residue. In some variants of cupredoxin derived peptide, one or more asparagine residues and one or more serine residues are substituted. In some embodiments, conservative substitutions are made. In other embodiments, non-conservative substitutions are made.

Deamidation of amino acid residues is a particular problem in biotransformation. This base-catalyzed reaction frequently occurs in sequences containing asparagine—glycine or glutamine—glycine and follows a mechanism analogous to the aspartic acid—glycine sequence above. The deamidation of the asparagine—glycine sequence forms a cyclic imide intermediate that is subsequently hydrolyzed to form the aspartate or iso-aspartate analog of asparagine. In addition, the cyclic imide intermediate can lead to racemization into D-aspartic acid or D-iso-aspartic acid analogs of asparagine, all of which can potentially lead to inactive forms of the peptide.

It is contemplated that deamidation in the cupredoxin peptides may be prevented by replacing a glycine, asparagine and/or glutamine of the asparagine—glycine or glutamine—glycine sequences of the cupredoxin with another amino acid and may result in a peptide with improved pharmacokinetic properties, such as a longer plasma half-life and increased specific activity of a pharmacologic activity of the peptide. In some embodiments, the one or more glycine residues of the cupredoxin derived peptide are replaced by another amino acid residue. In specific embodiments, one or more glycine residues of the cupredoxin derived peptide are replaced with a threonine or an alanine residue. In some embodiments, the one or more asparagine or glutamine residues of the cupredoxin derived peptide are replaced by another amino acid residue. In specific embodiments, one or more asparagine or glutamine residues of the cupredoxin derived peptide are replaced with an alanine residue. In other specific embodiments, the glycine at residues 58 and/or 63 of *P. aeruginosa* azurin (SEQ ID NO: 1), or equivalent glycines of other cupredoxins, are replaced with an alanine or a threonine. In other specific embodiments, the methionine at residue 59 of *P. aeruginosa* azurin (SEQ ID NO: 1), or an equivalent methionine residue of another cupredoxin derived peptide, is replaced by an alanine residue. In other specific embodiments, the glycine at residue 63 of *P. aeruginosa* azurin (SEQ ID NO: 1), or an equivalent glycine residue of another cupredoxin derived peptide, is replaced by an threonine residue. In some embodiments, conservative substitutions are made. In other embodiments, non-conservative substitutions are made. In specific embodiments, the modified cupredoxin derived peptide of the invention comprises the following sequence, wherein the underlined amino acids are substituted into the wild type *Pseudomonas aeruginosa* azurin sequence:

```
LSTAADMQAVVTDTMASGLDKDYLKPDD. (SEQ ID NO: 30)
```

Reversible and irreversible oxidation of amino acids are other biotransformative processes that may also pose a problem that may reduce the pharmacologic activity, and/or plasma half-life of cupredoxin derived peptides. The cysteine and methionine residues are the predominant residues that undergo reversible oxidation. Oxidation of cysteine is accelerated at higher pH, where the thiol is more easily deprotonated and readily forms intra-chain or inter-chain disulfide bonds. These disulfide bonds can be readily reversed in vitro by treatment with dithiothreitol (DTT) or tris(2-carboxyethylphosphine) hydrochloride (TCEP). Methionine oxidizes by both chemical and photochemical pathways to form methionine sufoxide and further into methionine sulfone, both of which are almost impossible to reverse.

It is contemplated that oxidation in the cupredoxin derived peptides may be prevented by replacing methionine and/or cysteine residues with other residues. In some embodiments, one or more methionine and/or cysteine residues of the cupredoxin derived peptide are replaced by another amino acid residue. In specific embodiments, the methionine residue is replaced with a leucine or valine residue. In other specific embodiments, one or more of the methionines at residues 56 and 64 of *P. aeruginosa* azurin (SEQ ID NO: 1), or equivalent methionine residues in other cupredoxin derived peptides, are replaced with leucine or valine. In some embodiments, conservative substitutions are made. In other embodiments, non-conservative substitutions are made. In specific embodiments, the cupredoxin peptides of the invention comprise one of the following sequences, wherein the underlined amino acid is substituted into the wild type *Pseudomonas aeruginosa* azurin sequence:

```
LSTAADLQGVVTDGLASGLDKDYLKPDD (SEQ ID NO: 31)
or

LSTAADVQGVVTDGVASGLDKDYLKPDD. (SEQ ID NO: 32)
```

Another biotransformative process that may affect the pharmacologic activity, plasma half-life and/or immunogenicity of the cupredoxin derived peptides is diketopiperazine and pyroglutamic acid formation. Diketopiperazine formation usually occurs when glycine is in the third position from the N-terminus, and more especially if proline or glycine is in position 1 or 2. The reaction involves nucleophilic attack of the N-terminal nitrogen on the amide carbonyl between the second and third amino acid, which leads to the cleavage of the first two amino acids in the form of a diketopiperazine. On the other hand, pyroglutamic acid formation may be almost inevitable if glutamine is in the N-terminus. This is an analogous reaction where the N-terminal nitrogen attacks the side chain carbonyl carbon of glutamine to form a deaminated pyroglutamayl peptide analog. This conversion also occurs in peptide containing asparagine in the N-terminus, but to a much lesser extent.

It is contemplated that diketopiperazine and pyroglutamic acid formation may be decreased in cupredoxin derived peptides by replacing glycine in position 1, 2, or 3 from the N-terminus, proline in position 3 from the N-terminus, or asparagine at the N-terminus of the peptide with another amino acid residue. In some embodiments, a glycine in positions 1, 2, or 3 from the N-terminus of the cupredoxin derived peptide is replaced with another amino acid residue. In specific embodiments, the glycine residue is replaced by a threonine or alanine residue. In another embodiment, a proline at position 3 from the N-terminus of the cupredoxin derived peptide is replaced with another amino acid residue. In specific embodiments, the proline is replaced by an alanine residue. In another embodiment, an asparagine at the N-terminus is replaced with another amino acid residue. In specific embodiments, the asparagine residue is replaced by a glutamine residue. In some embodiments, conservative substitutions are made. In other embodiments, non-conservative substitutions are made.

Another biotransformative process that may affect the pharmacologic activity, plasma half-life and/or immunogenicity of the cupredoxin derived peptide is racemization. This term is loosely used to refer to the overall loss of chiral integrity of the amino acid or peptide. Racemization involves the base-catalyzed conversion of one enantiomer (usually the L-form) of an amino acid into a 1:1 mixture of L-and D-enantiomers. One way to improve stability of the peptide in general is by making a retro-inverso (D-isomer) peptide. The double inversion of peptide structure often leaves the surface topology of the side-chain intact and has been used extensively to stabilize biologically active peptides. Snyder et al., PLoS Biol. 2:0186-0193 (2004). A D-amino acid substituted Tat is internalized into cells as well as the L-amino acid peptide. Futaki et al., J. Biol. Chem. 276:5836-5840 (2001); Huq et al., Biochemistry 38:5172-5177 (1999). In some embodiments, one or more amino acid residues of the cupredoxin derived peptide are replaced by the D-isomer of that amino acid residue. In other embodiments, all of the amino acid residues of the cupredoxin derived peptide are replaced with D-isomers of those residues. In one embodiment, the modified cupredoxin derived peptide is a retro-inverso (D-isomer) version of the cupredoxin derived peptide. In a specific embodiment, the modified cupredoxin derived peptide is

```
DDPKLYDKDLGSAMGDTVVGQMDAATSL. (SEQ ID NO: 45)
```

In other specific embodiments, the modified cupredoxin derived peptides are retro-inverso versions of cupredoxin derived peptides, including SEQ ID NOS: 1777-3504.

Other methods to protect a cupredoxin derived peptide from biotransformative degradation are N-acetylation and C-amidation. These derivatives may protect the peptide from degradation and may make the cupredoxin derived peptide more closely mimic the charge state of the alpha amino and carboxyl groups in the native protein. Peptides with the N-acetylation and/or C-amidation can be provided by commercial suppliers. In one embodiment of the invention, the N-terminus of the cupredoxin derived peptide may be acetylated. In another embodiment of the invention, the C-terminus of the cupredoxin derived peptides may be amidated. In one specific embodiment, the modified cupredoxin derived peptide is

```
                                    (SEQ ID NO: 33)
Acetylation-LSTAADMQGVVTDGMASGLDKDYLKPDD-

amidation.
```

Cyclization is an additional manner of biotransformation that may be beneficial to therapeutic peptides including the cupredoxins as described herein. Cyclization may stabilize therapeutic peptides, allowing them to be stored longer, be administered at lower doses and be administered less frequently. Cyclization has been shown to protect peptides against peptidase and protease degradation. Cyclization can be done chemically or enzymatically. Enzymatic cyclization is generally less problematic than chemical cyclization, as chemical cyclization can lack in regio-and stereospecificity, can lead to multimerization in lieu of cyclization and can require complicated multistep processes. Indeed, it has been shown that thioether cyclization is more protective and stable than a disulfide bond against proteolytic enzymes.

Enzymatic cyclization has been shown in lantibiotics—(methyl)lanthionine-containing bacterial peptides. E.g., R. Rink, et al., "Lantibiotic Structures as Guidelines for the Design of Peptides That Can Be Modified by Lantibioitic Enzymes" 44 Biochem., 8873-82 (2005); R. Rink, et al., "Production of Dehydroamino Acid-Containing Peptides by *Lactococcus lactis*" 73:6 Applied and Environmental Microbiology, 1792-96 (2007); R. Rink, et al., "NisC, the Cylcase of the Lantibiotic Nisin, Can Catalyze Cyclization of Designed Nonlantibiotic Peptides" 46 Biochem., 13179-89 (2007) (each of which is hereby incorporated by reference in its entirety). Lantibiotics are produced by and inhibit the growth of gram-positive bacteria. In lantibiotics, dehydroalanine and dehydrobutyrine are created by enzyme mediated dehydration of serine and threonine residues. Cysteines are then enzymatically coupled to the dehydrated serine and threonine residues to form thioether cyclizations. Naturally occurring lantibiotics show such couplings via thioether bonds between residues that are up to 19 residues apart. Thioether ring formation depends upon the leader peptide. The location of the cyclization depends upon the cyclase mediated regio-and stereospecific ring closure and the positions of the dehydratable serine and threonine residues.

The best characterized of the lantibiotics is nisin—a pentacyclic peptide antiobiotic produced by *Lactococcus lactis*. Nisin is composed of four methyllanthionines, one lanthionine, two dehydroalanines, one dehydrobutyrine, and twenty-six unmodified amino acids. Nisin's five thioether cross-links are formed by the addition of cysteine residues to dehydroalanine and dehydrobutyrine residues that originate from serine and threonine. Nisin contains thioether-containing amino acids that are posttranslationally introduced by a membrane-associated enzyme complex. This enzyme complex includes: transporter NisT, serine and threonine dehydratase NisB, and cyclase NisC. NisB dehydrates serine and threonine residues, converting them into dehydroalanine and dehydrobutyrine, respectively. This is followed by NisC catalyzed enantioselective coupling of cysteines to the formed dehydroresidues. NisT facilitates the export of the modified prenisin. Another enzyme, NisP cleaves the nisin leader peptide from prenisin.

The cyclase NisC has been well characterized. Li et al, "Structure and Mechanism of the Lantibiotic Cyclase Involved in Nisin Biosynthesis" 311 Science, 1464-67 (2006) (hereby incorporated by reference in its entirety).

An analysis of cyclization in lantibiotics has led to the identification of amino acid sequences and characteristics in peptides that favor cyclization. It has been shown that the NisB enzyme dehydrates more often where certain amino acids flank the serine and threonine residues. It has been shown that cyclization occurs more often in lantibiotic propeptides where hydrophobic, nonaromatic residues are in proximity to the serine and threonine residues. The flanking residues of the modified cysteines are typically less hydrophobic than the flanking residues of the modified threonines and serines. Exceptions have been found, including certain hexapeptides having a proline at position 3 or 4 or having phenylalanine flanking both sides, suggesting that amino acids in these positions may prohibit dehydration. The rings are typically formed by coupling a dehydrated residue to a C-terminally located cysteine. However, rings may be formed by coupling a dehydrate residue to a N-terminally located cysteine.

It has also been shown that the nisin dehydrating and transport enzymes are not specific to nisin and may, in fact, be used to modify non-nisin peptides (and non-lantibiotic peptides). NisB has been shown to dehydrate serine and threonine residues in peptides such as human peptide hormones when such peptides are N-terminally fused to the lantibiotic leader peptide. On non-lantibiotic peptides, similar ring formation characteristics apply; namely, the extent of dehydration can be controlled by the amino acid context of the flanking region of the dehydratable serine and threonine residues. The presence of hydrophobic flanking residues (e.g., alanine and valine) around the serines and threonines allowed full dehydration and therefore enhanced thioether ring formation. The presence of an N-terminal aspartate and C-terminally flanked arginine prevented dehydration. It also shown that the presence of proline residues and phenylalanine residues is disfavorable for dehydration. Generally, the presence of hydrophilic flanking residues prevented dehydration of the serine and threonine residues. Hydrophobic flanking favors dehydration; hydrophilic flanking disfavors dehydration. Studies have shown that where dehydration does occur, the average hydrophobicity of the flanking residues of serines and threonine is positive—0.40 on the N-terminal side and 0.13 on the C-terminal side. Also, the average hydrophobicity of the residues flanking serines and threonines that are not dehydrated is negative—−0.36 on the N-terminal side and −1.03 on the C-terminal side. Dehydration is not restricted by the presence of a series of flanking threonine residues and is not restricted by the distance between the nisin leader peptide and the residue to be dehydrated.

NisC has been shown to catalyze the regiospecific formation of thioether rings in peptides unrelated to naturally occurring lantibiotics. Generally, such peptides must be fused to the nisin leader peptide. In some cases, thioether rings may form spontaneously, for example where a dehydroalanine is spaced by two amino acids from a cysteine. Unlike spontaneous cyclization, NisC catalyzed cyclization is stereospecific for dehydrated pre-nisin. Consequently, the methyllanthionines and lanthionine in nisin are in the DL configuration. It is thought that cyclization in nonlantibiotic peptides will also be stereospecific These principles can be applied to the compounds described herein, including cupredoxins and variants and truncations thereof.

Thioether Bridges

In nature, lantibiotic-enzyme-induced thioether bridges occur with up to 19 amino acids under the bridge. Thioether bridges with 2 to 4 amino acids under the bridge are abundant.

Figure 4A:
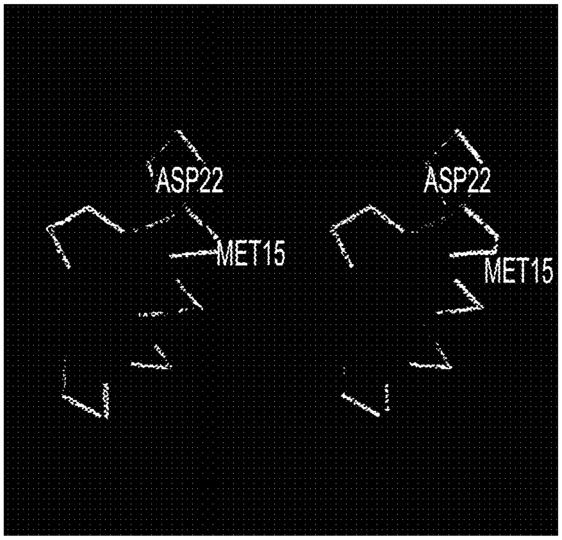
FIG. 4. Azurin truncation with alpha-helical structure and the results of a 70 ns simulation.
Figure 4B:
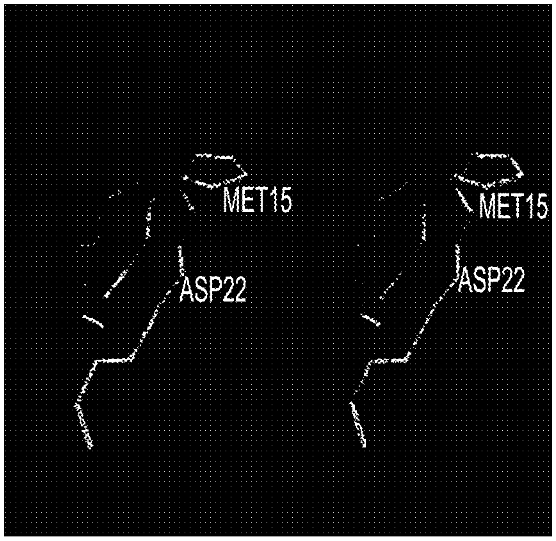

In some embodiments, the cupredoxin may be modified by introducing thioether bridges into the structure. The azurin truncation p28 (SEQ ID NO: 13), for example, may be modified using this method. Extended molecular dynamics simulations (70 ns) using software package GROMACS (www.gromacs.org) suggest that, at 37° C., the region of the p28 (SEQ ID NO: 13) alpha helix from position 6 to 16 is unstable, and that the peptide tends to adopt a beta sheet conformation. (See FIG. 4). This, together with the fact that the part of the molecule presumed to be responsible for interaction with p53 remains solvent exposed, suggests that introduction of a thioether bridge in this region of the p28 (SEQ ID NO: 13) peptide may not affect its functionality.

The amino acid sequence of p28 is SEQ ID NO: 13 (LSTAADMQGVVTDGMASGLDKDYLKPDD). The amino acid sequence known as p18 is SEQ ID NO: 14 (LSTAADMQGVVTDGMASG). Within p28 (SEQ ID NO: 13), the sequence SGLDKD (SEQ ID NO. 3531) may interact with p53. Thioether bridges can be formed between Ser/Thr on the N-side to Cys on the C-side. The serine/threonine may be dehydrated and subsequently coupled to the cysteine. Threonines are preferred since they are more easily dehydrated than serines. Generally, hydrophobic flanking residues (at least one) to the threonine are preferred since they enhance the extent of dehydration. Negatively charged amino acids, glutamate and aspartate, that are flanking residues have a strong negative effect on dehydration. Generally, hydrophilic flanking residues, especially glycine, do not favor dehydration. Preceding the Cys there is a slight preference for charged hydrophilic residues, especially glutamate/aspartate. Depending on the size of the thioether ring, the bulkiness of the amino acids that participate in the ring matters.

In one embodiment, the truncated azurin sequence is SEQ ID NO. 3507, LSTAADMQGVVTDGMASGLDKDYLTPGC. A thioether bridge is formed between positions 25 and 28, and will be fully protected against carboxyetidases. Positions 2, 3 and 25 will be dehydrated, but neither the import sequence, nor the sequence thought to be relevant for interaction with p53, is altered by thioether ring introduction. As such, peptide activity should not be altered. The threonine is between two hydrophobic amino acids and hence is expected to be fully dehydrated by dehydratase, NisB, according to specific guidelines. See Rink et al., Biochemistry 2005. The same guidelines also predict cyclization involving positions 25 and 28 by cyclase NisC, especially because of the aspartate located before the cysteine.

In another embodiment, the truncated azurin sequence is LSTAADCQGVVTDGMASGLDKDYLKPDD (SEQ ID NO. 3508) and the thioether bridge is formed between positions 3 and 7. The ring between position 3 and 7 mimics ring A of nisin and makes use of the existing threonine at position 2. The aspartate at position 6 will favor cyclization.

In another embodiment, the truncated azurin sequence is LSTAACMQGVVTDGMASGLDKDYLKPDD, (SEQ ID NO. 3509) and the threonine in position 2 is utilized to form a thioether bridge.

In another embodiment, two or more of the thioether rings in the truncated azurins described in the paragraphs above are combined into one peptide.

In another embodiment, many truncated azurin sequences can be created and screened for threonine rings by analyzing the peptides with a ring of one lanthionine and two to three additional amino acids under the sulfur bridge. As examples, this might involve one or combinations of the sequences below, where the bolded mutations facilitate complete modification:

LSTACDMQGVVTDGMASGLDKDYLKPDD (SEQ ID NO. 3510)

LSTAATMQCVVTDGMASGLDKDYLKPDD (SEQ ID NO. 3511)

LSTAATMQGCVTDGMASGLDKDYLKPDD (SEQ ID NO. 3512)

LSTAANTQGCVTDGMASGLDKDYLKPDD (SEQ ID NO. 3513)

LSTAANTQGVCTDGMASGLDKDYLKPDD (SEQ ID NO. 3514)

LSTAADMTAVCTDGMASGLDKDYLKPDD (SEQ ID NO. 3515)

LSTAADMTAVVCDGMASGLDKDYLKPDD (SEQ ID NO. 3516)

LSTAADMQTVVCDGMASGLDKDYLKPDD (SEQ ID NO. 3517)

LSTAADMQTVVTCGMASGLDKDYLKPDD (SEQ ID NO. 3518)

LSTAADMQATVTCGMASGLDKDYLKPDD (SEQ ID NO. 3519)

LSTAADMQATVTDCMASGLDKDYLKPDD (SEQ ID NO. 3520)

LSTAADMQGVTADCMASGLDKDYLKPDD (SEQ ID NO. 3521)

LSTAADMQGVTADGCASGLDKDYLKPDD (SEQ ID NO. 3522)

LSTAADMQGVVTNGCASGLDKDYLKPDD (SEQ ID NO. 3523)

A practical approach would be to genetically make a large number of such sequences and select a group for purification on the basis of extent of modification and level of production.

Figure 5:
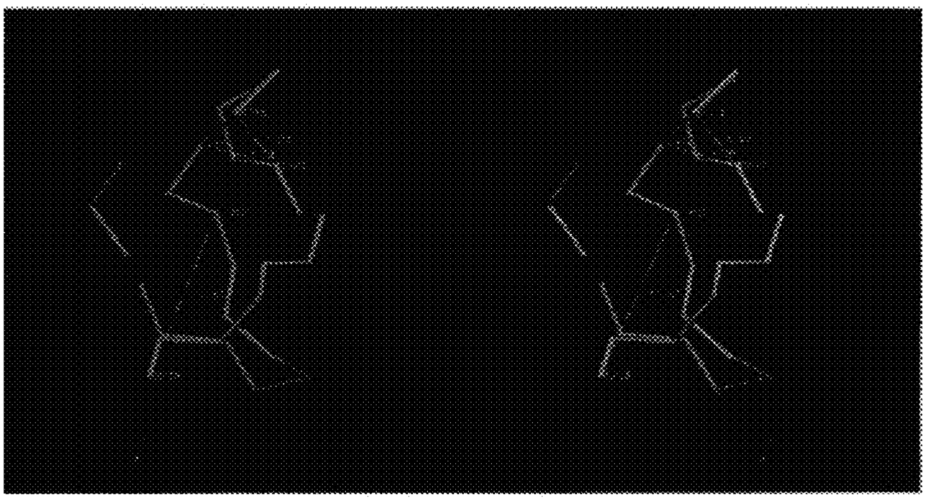
FIG. 5. Measurement of thioether bridge positions in p28 (SEQ ID NO: 13) based on distances between Ca atoms in a simulated structure.

In another embodiment, a thioether bridge is formed between a threonine at position 12 in p28 (SEQ ID NO: 13) and the c-terminus of the peptide. The distance between the Cα of position 13 and the aspartate at position 28 might be 17.52 angstroms, larger than 1.5 nanometers, implying significant alteration of the structure of the peptide. (See FIG. 5.)

In another embodiment, the peptide sequence is LSTAADMQGVVTATMGSGLCKDYLKPDD, (SEQ ID NO. 3524) with a thioether bridge from position 14 to position 2 at a distance of 4.38 angstroms. The mutation of aspartate at position 13 to alanine favors dehydration of threonine at position 14. Mutation of alanine at position 16 to glycine completely prevents dehydration of serine at position 17 and enhances cyclization.

In another embodiment, the peptide sequence is LSTAADMQGVVTDLTASGLCKDYLKPDD, (SEQ ID NO. 3525) with the thioether bridge from position 15 to position 20 at a distance of 5.83 angstroms. In this situation, mutation of glycine at position 14 to leucine favors dehydration of threonine at position 15.

Tertiary Structure Stabilization

The stability of the tertiary structure of the cupredoxin derived peptide will affect most aspects of the pharmacokinetics, including the pharmacologic activity, plasma half-life, and/or immunogenicity among others. See Kanovsky et al., Cancer Chemother. Pharmacol. 52:202-208 (2003); Kanovsky et al., PNAS 23:12438-12443 (2001). Peptide helices often fall apart into random coils, becoming more susceptible to protease attack and may not penetrate cell membrane well. Schafineister et al., J. Am. Chem. Soc. 122:5891-5892 (2000). Therefore, one way to stabilize the overall structure of the peptide is to stabilize the α-helix structure of the peptide. The intra-molecular hydrogen bonding associated with helix formation reduces the exposure of the polar amide backbone, thereby reducing the barrier to membrane penetration in a transport peptide, and thus increasing related pharmacologic activities and increasing the resistance of the peptide to protease cleavage. Id. *Pseudomonas aeruginosa* azurin (SEQ ID NO: 1) has α-helices at residues 53-56, 58-64 and 68-70.

One method to stabilize an α-helix is to replace in the α-helix helix breaking amino acid residues such as glycine, proline, serine and aspartic acid, or helix neutral amino acid residues such as alanine, threonine, valine, glutamine, asparagine, cysteine, histidine, lysine or arginine, with helix forming residues, such as leucine, isoleucine, phenylalanine, glutamic acid, tyrosine, tryptophan and methionine or helix favoring amino acid residue substitutions, for example α-amino-isobutyric acid (Aib). See Miranda et al., J. Med. Chem., 51, 2758-2765 (2008). It is contemplated that the α-helix of cupredoxin derived peptides may be stabilized by replacing one or more glycine, proline, serine and/or aspartic acid residues with other amino acids. In specific embodiments, the glycine, proline, serine, aspartic acid, alanine, threonine, valine, glutamine, asparagine, cysteine, histidine, lysine and/or arginine residues are replaced by leucine, isoleucine, phenylalanine, glutamic acid, tyrosine, tryptophan, Aib and/or methionine residues. See Lee et al., Cancer Cell Intl. 11:21 (2005). In other specific embodiments, one or more serine or glutamine residues in the α-helices of a cupredoxin derived peptide may be substituted. In still more specific embodiments, the serine and/or glutamine residues in residues 53-56, 58-64 and 68-70 of *P. aeruginosa* azurin (SEQ ID NO: 1), or equivalent residues of other cupredoxin derived peptides, may be replaced. In another specific embodiment, the glutamine residue at amino acid residue 57 of *P. aeruginosa* azurin (SEQ ID NO: 1), or an equivalent residue of another cupredoxin derived peptide, may be replaced, more specifically replaced with tryptophan. In another specific embodiment, the threonine residue at amino acid residue 52 of *P. aeruginosa* azurin (SEQ ID NO: 1), or an equivalent residue of another cupredoxin derived peptide, may be replaced, more specifically replaced with tryptophan. In another specific embodiment, the threonine residue at amino acid residue 61 of *P. aeruginosa* azurin (SEQ ID NO: 1), or an equivalent residue of another cupredoxin derived peptide, may be replaced, more specifically replaced with tryptophan. In another specific embodiment, the glycine residue at amino acid residue 63 of *P. aeruginosa* azurin (SEQ ID NO: 1), or an equivalent residue of another cupredoxin derived peptide, may be replaced, more specifically replaced with tryptophan. In another specific embodiment, one or more threonine, glutamine or glycine residues at amino acid residues 52, 57, 61 or 63 of *P. aeruginosa* azurin (SEQ ID NO: 1), or an equivalent residue of another cupredoxin derived peptide, may be replaced, more specifically replaced with tryptophan. In specific embodiments, the cupredoxin peptide comprises one of the following sequences wherein the underlined amino acid is substituted into the wild type

LSWAADMQGVVTDGMASGLDKDYLKPDD; (SEQ ID NO: 34)

LSTAADMWGVVTDGMASGLDKDYLKPDD; (SEQ ID NO: 35)

LSTAADMQGVVWDGMASGLDKDYLKPDD; (SEQ ID NO: 36)

LSTAADMQGVVTDWMASGLDKDYLKPDD; (SEQ ID NO: 37)

LSWAADMWGVVTDGMASGLDKDYLKPDD; (SEQ ID NO: 38)

LSWAADMQGVVWDGMASGLDKDYLKPDD; (SEQ ID NO: 39)

LSWAADMQGVVTDWMASGLDKDYLKPDD; (SEQ ID NO: 40)

LSTAADMWGVVWDGMASGLDKDYLKPDD; (SEQ ID NO: 41)

LSTAADMWGVVTDWMASGLDKDYLKPDD; (SEQ ID NO: 42)

LSTAADMQGVVWDWMASGLDKDYLKPDD; (SEQ ID NO: 43)
or

LSWAADMWGVVWDWMASGLDKDYLKPDD. (SEQ ID NO: 44)

In other embodiments, equivalent amino acids in other cupredoxin derived peptides are substituted with tryptophan.

Another method to stabilize an α-helix tertiary structure involves using unnatural amino acid residues capable of π-stacking. For example, in Andrews and Tabor (Tetrahedron 55:11711-11743 (1999)), pairs of ϵ-(3,5-dinitrobenzoyl)-Lys residues were substituted into the α-helix region of a peptide at different spacings. The overall results showed that the i,(i+4) spacing was the most effective stabilizing arrangement. Increasing the percentage of water, up to 90%, increased the helical content of the peptide. Pairs of ϵ-acyl-Lys residues in the same i,(i+4) spacing had no stabilizing effect, indicating that the majority of the stabilization arises from π-π interactions. In one embodiment, the cupredoxin derived peptide may be modified so that the lysine residues are substituted by ϵ-(3,5-dinitrobenzoyl)-Lys residues. In a specific embodiment, the lysine residues may be substituted by ϵ-(3,5-dinitrobenzoyl)-Lys in a i,(i+4) spacing.

Another method to stabilize an α-helix tertiary structure uses the electrostatic interactions between side-chains in the α-helix. When His-Cys or His-His residue pairs were substituted in into peptides in an i,(i+4) arrangement, the peptides changed from about 50% helical to about 90% helical on the addition of Cu, Zn or Cd ions. When ruthenium (Ru) salts were added to the His-His peptides, an exchange-inert complex was formed, a macrocyclic cis-$[Ru—(NH_3)_4L_2]^{3+}$ complex where $L_2$ are the side chains of two histidines, which improved the helix stability. Ghadiri and Fernholz, J. Am. Chem. Soc. 112, 9633-9635 (1990). In some embodiments, the cupredoxin derived peptides may comprise macrocyclic cis-$[Ru—(NH_3)_4L_2]^{3+}$ complexes where $L_2$ is the side chains of two histidines. In some embodiments, one or more histidine-cysteine or histidine-histidine residue pairs may be substituted an i,(i+4) arrangement into the α-helices of the cupredoxin derived peptide. In other embodiments, one or more histidine-cysteine or histidine-histidine residue pairs may be substituted an i,(i+4) arrangement in residues 53-56, 58-64 and 68-70 of *P. aeruginosa* azurin (SEQ ID NO: 1), or equivalent residues of other cupredoxin derived peptides. In some embodiments, the cupredoxin derived peptide may further comprise Cu, Zn, Cd and/or Ru ions.

Another method to stabilize an α-helix tertiary structure involves disulfide bond formation between side-chains of the α-helix. It is also possible to stabilize helical structures by means of formal covalent bonds between residues separated in the peptide sequence. The commonly employed natural method is to use disulfide bonds. Pierret et al., Intl. J. Pept. Prot. Res., 46:471-479 (1995). In some embodiments, one or more cysteine residue pairs are substituted into the α-helices of the cupredoxin derived peptide. In other embodiments, one or more cysteine residue pairs are substituted at residues 53-56, 58-64 and 68-70 of *P. aeruginosa* azurin (SEQ ID NO: 1), or equivalent residues of other cupredoxin derived peptides.

Another method to stabilize an α-helical tertiary structure involves the use of side chain lactam bridges. A lactam is a cyclic amide which can form from the cyclization of amino acids. Side chain to side chain bridges have been successfully used as constraints in a variety of peptides and peptide analogues, such as amphipathic or model α-helical peptides, oxytocin antagonists, melanoptropin analogues, glucagon, and SDF-1 peptide analogues. For example, the Glucagon-like Peptide-1 (GLP-1) gradually assumes a helical conformation under certain helix-favoring conditions and can be stabilized using lactam bridging. Miranda et al., J. Med. Chem., 51, 2758-2765 (2008). These lactam bridges may be varied in size, effecting stability and binding affinity. Id. Such modifications improved the stability of the compounds in plasma. Id. Depending on the space between the cyclization sites and choice of residues, lactam bridges can be used to induce and stabilize turn or helical conformations. In some embodiments, one or more cupredoxin or variant analogues are prepared with lactam bridging between nearby amino acids (such as i to i+4 glutamic acid-lysine constraints). In some embodiments, the cupredoxin derived peptide may comprise such modifications to enhance α-helix content.

Another method to stabilize an α-helix tertiary structure is the all-carbon cross-link method. The all-hydrocarbon cross-link method is proven to increase the stabilization of helical structure, protease resistant and cell-permeability. Walensky et al., Science, 305, 1466-1470 (2004). α,α-disubstituted non-natural amino acids containing olefin-bearing tethers are incorporated into peptides. Ruthenium catalyzed olefin metathesis generates an all-hydrocarbon "staple" to cross-link the helix. Schafineister et al., J. Am. Chem. Soc., 122, 5891-5892 (2000); Walensky et al., id. Non-natural amino acids containing olefin-bearing tethers may be synthesized according to methodology provided in Schafineister et al. (id.) and Williams and Im (J. Am. Chem. Soc., 113:9276-9286 (1991)). In some embodiments, the cupredoxin derived peptides are stabilized by all-hydrocarbon staples. In specific embodiments, one or more pairs of α,α-disubstituted non-natural amino acids containing olefin-bearing tethers corresponding to the native amino acids are substituted into the α-helices of the cupredoxin derived peptide. In other embodiments, one or more pairs of α,α-disubstituted non-natural amino acids containing olefin-bearing tethers corresponded to the native amino acids are substituted into residues 53-56, 58-64 and 68-70 of *P. aeruginosa* azurin (SEQ ID NO: 1), or equivalent residues of other cupredoxin derived peptides.

In some embodiments, the modified cupredoxin derived peptide may comprise $X_1SX_2AADX_3X_4X_5VVX_6DX_7X_8ASGLDKDYLKPDX_9$ (SEQ ID NO:48), where $X_1$ is L or acetylated-L, $X_2$ is T or W, $X_3$ is M, L or V, $X_4$ is Q or W, $X_5$ is G or A, $X_6$ is T or W, $X_7$ is G, T or W, $X_8$ is M, L or V, and $X_9$ is D or amidated-D. In other embodiments, the modified cupredoxin derived peptide may consist of $X_1SX_2AADX_3X_4X_5VVX_6DX_7X_8ASGLDKDYLKPDX_9$ (SEQ ID NO:48), where $X_1$ is L or acetylated-L, $X_2$ is T or W, $X_3$ is M, L or V, $X_4$ is Q or W, $X_5$ is G or A, $X_6$ is T or We $X_7$ is G, T or W, $X_8$ is M, L or V, and Xg is D or amidated-D. In other embodiments, the modified cupredoxin derived peptide may comprise $X_1DPKLYDKDLGSAX_2X_3DX_4VVX_5X_6X_7DAAX_8SX_9$ (SEQ ID NO:49), where $X_1$ is D or acetylated-D, $X_2$ is M, L or V, $X_3$ is G, T or W, $X_4$ is T or W, $X_5$ is G or A, $X_6$ is Q or W, $X_7$ is M, L or V, $X_8$ is T or W, and $X_9$ is L or amidated-L. In other embodiments, the modified cupredoxin derived peptide may consist of $X_1DPKLYDKDLGSAX_xX_3DX_4VVX_5X_6X_7DAAX_8SX_9$ (SEQ ID NO:49), where $X_1$ is D or acetylated-D, $X_2$ is M, L or V, $X_3$ is G, T or W, $X_4$ is T or W, $X_5$ is G or A, $X_6$ is Q or W, $X_7$ is M, L or V, $X_8$ is T or W, and $X_9$ is L or amidated-L. Specific peptides of interest are listed in Table 3.

TABLE 3

| Modified Curedoxin-Derived Peptides | |
|---|---|
| *LSTAADMQGVVTDGMASGLDKDYLKPDD | (SEQ ID NO: 50) |
| LSWAADMQGVVTDGMASGLDKDYLKPDD | (SEQ ID NO: 51) |
| *LSWAADMQGVVTDGMASGLDKDYLKPDD | (SEQ ID NO: 52) |
| LSTAADLQGVVTDGMASGLDKDYLKPDD | (SEQ ID NO: 53) |
| *LSTAADLQGVVTDGMASGLDKDYLKPDD | (SEQ ID NO: 54) |
| LSWAADLQGVVTDGMASGLDKDYLKPDD | (SEQ ID NO: 55) |
| *LSWAADLQGVVTDGMASGLDKDYLKPDD | (SEQ ID NO: 56) |
| LSTAADVQGVVTDGMASGLDKDYLKPDD | (SEQ ID NO: 57) |
| *LSTAADVQGVVTDGMASGLDKDYLKPDD | (SEQ ID NO: 58) |
| LSWAADVQGVVTDGMASGLDKDYLKPDD | (SEQ ID NO: 59) |
| *LSWAADVQGVVTDGMASGLDKDYLKPDD | (SEQ ID NO: 60) |
| LSTAADMWGVVTDGMASGLDKDYLKPDD | (SEQ ID NO: 61) |
| *LSTAADMWGVVTDGMASGLDKDYLKPDD | (SEQ ID NO: 62) |
| LSWAADMWGVVTDGMASGLDKDYLKPDD | (SEQ ID NO: 63) |
| *LSWAADMWGVVTDGMASGLDKDYLKPDD | (SEQ ID NO: 64) |
| LSTAADLWGVVTDGMASGLDKDYLKPDD | (SEQ ID NO: 65) |
| *LSTAADLWGVVTDGMASGLDKDYLKPDD | (SEQ ID NO: 66) |
| LSWAADLWGVVTDGMASGLDKDYLKPDD | (SEQ ID NO: 67) |
| *LSWAADLWGVVTDGMASGLDKDYLKPDD | (SEQ ID NO: 68) |
| LSTAADVWGVVTDGMASGLDKDYLKPDD | (SEQ ID NO: 69) |

TABLE 3-continued

| Modified Curedoxin-Derived Peptides | |
|---|---|
| *LSTAADVWGVVTDGMASGLDKDYLKPDD | (SEQ ID NO: 70) |
| LSWAADVWGVVTDGMASGLDKDYLKPDD | (SEQ ID NO: 71) |
| *LSWAADVWGVVTDGMASGLDKDYLKPDD | (SEQ ID NO: 72) |
| LSTAADMQAVVTDGMASGLDKDYLKPDD | (SEQ ID NO: 73) |
| *LSTAADMQAVVTDGMASGLDKDYLKPDD | (SEQ ID NO: 74) |
| LSWAADMQAVVTDGMASGLDKDYLKPDD | (SEQ ID NO: 75) |
| *LSWAADMQAVVTDGMASGLDKDYLKPDD | (SEQ ID NO: 76) |
| LSTAADLQAVVTDGMASGLDKDYLKPDD | (SEQ ID NO: 77) |
| *LSTAADLQAVVTDGMASGLDKDYLKPDD | (SEQ ID NO: 78) |
| LSWAADLQAVVTDGMASGLDKDYLKPDD | (SEQ ID NO: 79) |
| *LSWAADLQAVVTDGMASGLDKDYLKPDD | (SEQ ID NO: 80) |
| LSTAADVQAVVTDGMASGLDKDYLKPDD | (SEQ ID NO: 81) |
| *LSTAADVQAVVTDGMASGLDKDYLKPDD | (SEQ ID NO: 82) |
| LSWAADVQAVVTDGMASGLDKDYLKPDD | (SEQ ID NO: 83) |
| *LSWAADVQAVVTDGMASGLDKDYLKPDD | (SEQ ID NO: 84) |
| LSTAADMWAVVTDGMASGLDKDYLKPDD | (SEQ ID NO: 85) |
| *LSTAADMWAVVTDGMASGLDKDYLKPDD | (SEQ ID NO: 86) |
| LSWAADMWAVVTDGMASGLDKDYLKPDD | (SEQ ID NO: 87) |
| *LSWAADMWAVVTDGMASGLDKDYLKPDD | (SEQ ID NO: 88) |
| LSTAADLWAVVTDGMASGLDKDYLKPDD | (SEQ ID NO: 89) |
| *LSTAADLWAVVTDGMASGLDKDYLKPDD | (SEQ ID NO: 90) |
| LSWAADLWAVVTDGMASGLDKDYLKPDD | (SEQ ID NO: 91) |
| *LSWAADLWAVVTDGMASGLDKDYLKPDD | (SEQ ID NO: 92) |
| LSTAADVWAVVTDGMASGLDKDYLKPDD | (SEQ ID NO: 93) |
| *LSTAADVWAVVTDGMASGLDKDYLKPDD | (SEQ ID NO: 94) |
| LSWAADVWAVVTDGMASGLDKDYLKPDD | (SEQ ID NO: 95) |
| *LSWAADVWAVVTDGMASGLDKDYLKPDD | (SEQ ID NO: 96) |
| LSTAADMQGVVWDGMASGLDKDYLKPDD | (SEQ ID NO: 97) |
| *LSTAADMQGVVWDGMASGLDKDYLKPDD | (SEQ ID NO: 98) |
| LSWAADMQGVVWDGMASGLDKDYLKPDD | (SEQ ID NO: 99) |
| *LSWAADMQGVVWDGMASGLDKDYLKPDD | (SEQ ID NO: 100) |
| LSTAADLQGVVWDGMASGLDKDYLKPDD | (SEQ ID NO: 101) |
| *LSTAADLQGVVWDGMASGLDKDYLKPDD | (SEQ ID NO: 102) |
| LSWAADLQGVVWDGMASGLDKDYLKPDD | (SEQ ID NO: 103) |
| *LSWAADLQGVVWDGMASGLDKDYLKPDD | (SEQ ID NO: 104) |
| LSTAADVQGVVWDGMASGLDKDYLKPDD | (SEQ ID NO: 105) |
| *LSTAADVQGVVWDGMASGLDKDYLKPDD | (SEQ ID NO: 106) |
| LSWAADVQGVVWDGMASGLDKDYLKPDD | (SEQ ID NO: 107) |
| *LSWAADVQGVVWDGMASGLDKDYLKPDD | (SEQ ID NO: 108) |

TABLE 3-continued

| Modified Curedoxin-Derived Peptides | |
|---|---|
| LSTAADMWGVVWDGMASGLDKDYLKPDD | (SEQ ID NO: 109) |
| *LSTAADMWGVVWDGMASGLDKDYLKPDD | (SEQ ID NO: 110) |
| LSWAADMWGVVWDGMASGLDKDYLKPDD | (SEQ ID NO: 111) |
| *LSWAADMWGVVWDGMASGLDKDYLKPDD | (SEQ ID NO: 112) |
| LSTAADLWGVVWDGMASGLDKDYLKPDD | (SEQ ID NO: 113) |
| *LSTAADLWGVVWDGMASGLDKDYLKPDD | (SEQ ID NO: 114) |
| LSWAADLWGVVWDGMASGLDKDYLKPDD | (SEQ ID NO: 115) |
| *LSWAADLWGVVWDGMASGLDKDYLKPDD | (SEQ ID NO: 116) |
| LSTAADVWGVVWDGMASGLDKDYLKPDD | (SEQ ID NO: 117) |
| *LSTAADVWGVVWDGMASGLDKDYLKPDD | (SEQ ID NO: 118) |
| LSWAADVWGVVWDGMASGLDKDYLKPDD | (SEQ ID NO: 119) |
| *LSWAADVWGVVWDGMASGLDKDYLKPDD | (SEQ ID NO: 120) |
| LSTAADMQAVVWDGMASGLDKDYLKPDD | (SEQ ID NO: 121) |
| *LSTAADMQAVVWDGMASGLDKDYLKPDD | (SEQ ID NO: 122) |
| LSWAADMQAVVWDGMASGLDKDYLKPDD | (SEQ ID NO: 123) |
| *LSWAADMQAVVWDGMASGLDKDYLKPDD | (SEQ ID NO: 124) |
| LSTAADLQAVVWDGMASGLDKDYLKPDD | (SEQ ID NO: 125) |
| *LSTAADLQAVVWDGMASGLDKDYLKPDD | (SEQ ID NO: 126) |
| LSWAADLQAVVWDGMASGLDKDYLKPDD | (SEQ ID NO: 127) |
| *LSWAADLQAVVWDGMASGLDKDYLKPDD | (SEQ ID NO: 128) |
| LSTAADVQAVVWDGMASGLDKDYLKPDD | (SEQ ID NO: 129) |
| *LSTAADVQAVVWDGMASGLDKDYLKPDD | (SEQ ID NO: 130) |
| LSWAADVQAVVWDGMASGLDKDYLKPDD | (SEQ ID NO: 131) |
| *LSWAADVQAVVWDGMASGLDKDYLKPDD | (SEQ ID NO: 132) |
| LSTAADMWAVVWDGMASGLDKDYLKPDD | (SEQ ID NO: 133) |
| *LSTAADMWAVVWDGMASGLDKDYLKPDD | (SEQ ID NO: 134) |
| LSWAADMWAVVWDGMASGLDKDYLKPDD | (SEQ ID NO: 135) |
| *LSWAADMWAVVWDGMASGLDKDYLKPDD | (SEQ ID NO: 136) |
| LSTAADLWAVVWDGMASGLDKDYLKPDD | (SEQ ID NO: 137) |
| *LSTAADLWAVVWDGMASGLDKDYLKPDD | (SEQ ID NO: 138) |
| LSWAADLWAVVWDGMASGLDKDYLKPDD | (SEQ ID NO: 139) |
| *LSWAADLWAVVWDGMASGLDKDYLKPDD | (SEQ ID NO: 140) |
| LSTAADVWAVVWDGMASGLDKDYLKPDD | (SEQ ID NO: 141) |
| *LSTAADVWAVVWDGMASGLDKDYLKPDD | (SEQ ID NO: 142) |
| LSWAADVWAVVWDGMASGLDKDYLKPDD | (SEQ ID NO: 143) |
| *LSWAADVWAVVWDGMASGLDKDYLKPDD | (SEQ ID NO: 144) |
| LSTAADMQGVVTDTMASGLDKDYLKPDD | (SEQ ID NO: 145) |
| *LSTAADMQGVVTDTMASGLDKDYLKPDD | (SEQ ID NO: 146) |
| LSWAADMQGVVTDTMASGLDKDYLKPDD | (SEQ ID NO: 147) |

TABLE 3-continued

| Modified Curedoxin-Derived Peptides | |
|---|---|
| *LSWAADMQGVVTDTMASGLDKDYLKPDD | (SEQ ID NO: 148) |
| LSTAADLQGVVTDTMASGLDKDYLKPDD | (SEQ ID NO: 149) |
| *LSTAADLQGVVTDTMASGLDKDYLKPDD | (SEQ ID NO: 150) |
| LSWAADLQGVVTDTMASGLDKDYLKPDD | (SEQ ID NO: 151) |
| *LSWAADLQGVVTDTMASGLDKDYLKPDD | (SEQ ID NO: 152) |
| LSTAADVQGVVTDTMASGLDKDYLKPDD | (SEQ ID NO: 153) |
| *LSTAADVQGVVTDTMASGLDKDYLKPDD | (SEQ ID NO: 154) |
| LSWAADVQGVVTDTMASGLDKDYLKPDD | (SEQ ID NO: 155) |
| *LSWAADVQGVVTDTMASGLDKDYLKPDD | (SEQ ID NO: 156) |
| LSTAADMWGVVTDTMASGLDKDYLKPDD | (SEQ ID NO: 157) |
| *LSTAADMWGVVTDTMASGLDKDYLKPDD | (SEQ ID NO: 158) |
| LSWAADMWGVVTDTMASGLDKDYLKPDD | (SEQ ID NO: 159) |
| *LSWAADMWGVVTDTMASGLDKDYLKPDD | (SEQ ID NO: 160) |
| LSTAADLWGVVTDTMASGLDKDYLKPDD | (SEQ ID NO: 161) |
| *LSTAADLWGVVTDTMASGLDKDYLKPDD | (SEQ ID NO: 162) |
| LSWAADLWGVVTDTMASGLDKDYLKPDD | (SEQ ID NO: 163) |
| *LSWAADLWGVVTDTMASGLDKDYLKPDD | (SEQ ID NO: 164) |
| LSTAADVWGVVTDTMASGLDKDYLKPDD | (SEQ ID NO: 165) |
| *LSTAADVWGVVTDTMASGLDKDYLKPDD | (SEQ ID NO: 166) |
| LSWAADVWGVVTDTMASGLDKDYLKPDD | (SEQ ID NO: 167) |
| *LSWAADVWGVVTDTMASGLDKDYLKPDD | (SEQ ID NO: 168) |
| LSTAADMQAVVTDTMASGLDKDYLKPDD | (SEQ ID NO: 169) |
| *LSTAADMQAVVTDTMASGLDKDYLKPDD | (SEQ ID NO: 170) |
| LSWAADMQAVVTDTMASGLDKDYLKPDD | (SEQ ID NO: 171) |
| *LSWAADMQAVVTDTMASGLDKDYLKPDD | (SEQ ID NO: 172) |
| LSTAADLQAVVTDTMASGLDKDYLKPDD | (SEQ ID NO: 173) |
| *LSTAADLQAVVTDTMASGLDKDYLKPDD | (SEQ ID NO: 174) |
| LSWAADLQAVVTDTMASGLDKDYLKPDD | (SEQ ID NO: 175) |
| *LSWAADLQAVVTDTMASGLDKDYLKPDD | (SEQ ID NO: 176) |
| LSTAADVQAVVTDTMASGLDKDYLKPDD | (SEQ ID NO: 177) |
| *LSTAADVQAVVTDTMASGLDKDYLKPDD | (SEQ ID NO: 178) |
| LSWAADVQAVVTDTMASGLDKDYLKPDD | (SEQ ID NO: 179) |
| *LSWAADVQAVVTDTMASGLDKDYLKPDD | (SEQ ID NO: 180) |
| LSTAADMWAVVTDTMASGLDKDYLKPDD | (SEQ ID NO: 181) |
| *LSTAADMWAVVTDTMASGLDKDYLKPDD | (SEQ ID NO: 182) |
| LSWAADMWAVVTDTMASGLDKDYLKPDD | (SEQ ID NO: 183) |
| *LSWAADMWAVVTDTMASGLDKDYLKPDD | (SEQ ID NO: 184) |
| LSTAADLWAVVTDTMASGLDKDYLKPDD | (SEQ ID NO: 185) |
| *LSTAADLWAVVTDTMASGLDKDYLKPDD | (SEQ ID NO: 186) |

TABLE 3-continued

| Modified Curedoxin-Derived Peptides | |
|---|---|
| LSWAADLWAVVTDTMASGLDKDYLKPDD | (SEQ ID NO: 187) |
| *LSWAADLWAVVTDTMASGLDKDYLKPDD | (SEQ ID NO: 188) |
| LSTAADVWAVVTDTMASGLDKDYLKPDD | (SEQ ID NO: 189) |
| *LSTAADVWAVVTDTMASGLDKDYLKPDD | (SEQ ID NO: 190) |
| LSWAADVWAVVTDTMASGLDKDYLKPDD | (SEQ ID NO: 191) |
| *LSWAADVWAVVTDTMASGLDKDYLKPDD | (SEQ ID NO: 192) |
| LSTAADMQGVVWDTMASGLDKDYLKPDD | (SEQ ID NO: 193) |
| *LSTAADMQGVVWDTMASGLDKDYLKPDD | (SEQ ID NO: 194) |
| LSWAADMQGVVWDTMASGLDKDYLKPDD | (SEQ ID NO: 195) |
| *LSWAADMQGVVWDTMASGLDKDYLKPDD | (SEQ ID NO: 196) |
| LSTAADLQGVVWDTMASGLDKDYLKPDD | (SEQ ID NO: 197) |
| *LSTAADLQGVVWDTMASGLDKDYLKPDD | (SEQ ID NO: 198) |
| LSWAADLQGVVWDTMASGLDKDYLKPDD | (SEQ ID NO: 199) |
| *LSWAADLQGVVWDTMASGLDKDYLKPDD | (SEQ ID NO: 200) |
| LSTAADVQGVVWDTMASGLDKDYLKPDD | (SEQ ID NO: 201) |
| *LSTAADVQGVVWDTMASGLDKDYLKPDD | (SEQ ID NO: 202) |
| LSWAADVQGVVWDTMASGLDKDYLKPDD | (SEQ ID NO: 203) |
| *LSWAADVQGVVWDTMASGLDKDYLKPDD | (SEQ ID NO: 204) |
| LSTAADMWGVVWDTMASGLDKDYLKPDD | (SEQ ID NO: 205) |
| *LSTAADMWGVVWDTMASGLDKDYLKPDD | (SEQ ID NO: 206) |
| LSWAADMWGVVWDTMASGLDKDYLKPDD | (SEQ ID NO: 207) |
| *LSWAADMWGVVWDTMASGLDKDYLKPDD | (SEQ ID NO: 208) |
| LSTAADLWGVVWDTMASGLDKDYLKPDD | (SEQ ID NO: 209) |
| *LSTAADLWGVVWDTMASGLDKDYLKPDD | (SEQ ID NO: 210) |
| LSWAADLWGVVWDTMASGLDKDYLKPDD | (SEQ ID NO: 211) |
| *LSWAADLWGVVWDTMASGLDKDYLKPDD | (SEQ ID NO: 212) |
| LSTAADVWGVVWDTMASGLDKDYLKPDD | (SEQ ID NO: 213) |
| *LSTAADVWGVVWDTMASGLDKDYLKPDD | (SEQ ID NO: 214) |
| LSWAADVWGVVWDTMASGLDKDYLKPDD | (SEQ ID NO: 215) |
| *LSWAADVWGVVWDTMASGLDKDYLKPDD | (SEQ ID NO: 216) |
| LSTAADMQAVVWDTMASGLDKDYLKPDD | (SEQ ID NO: 217) |
| *LSTAADMQAVVWDTMASGLDKDYLKPDD | (SEQ ID NO: 218) |
| LSWAADMQAVVWDTMASGLDKDYLKPDD | (SEQ ID NO: 219) |
| *LSWAADMQAVVWDTMASGLDKDYLKPDD | (SEQ ID NO: 220) |
| LSTAADLQAVVWDTMASGLDKDYLKPDD | (SEQ ID NO: 221) |
| *LSTAADLQAVVWDTMASGLDKDYLKPDD | (SEQ ID NO: 222) |
| LSWAADLQAVVWDTMASGLDKDYLKPDD | (SEQ ID NO: 223) |
| *LSWAADLQAVVWDTMASGLDKDYLKPDD | (SEQ ID NO: 224) |
| LSTAADVQAVVWDTMASGLDKDYLKPDD | (SEQ ID NO: 225) |

TABLE 3-continued

| Modified Curedoxin-Derived Peptides | |
|---|---|
| *LSTAADVQAVVWDTMASGLDKDYLKPDD | (SEQ ID NO: 226) |
| LSWAADVQAVVWDTMASGLDKDYLKPDD | (SEQ ID NO: 227) |
| *LSWAADVQAVVWDTMASGLDKDYLKPDD | (SEQ ID NO: 228) |
| LSTAADMWAVVWDTMASGLDKDYLKPDD | (SEQ ID NO: 229) |
| *LSTAADMWAVVWDTMASGLDKDYLKPDD | (SEQ ID NO: 230) |
| LSWAADMWAVVWDTMASGLDKDYLKPDD | (SEQ ID NO: 231) |
| *LSWAADMWAVVWDTMASGLDKDYLKPDD | (SEQ ID NO: 232) |
| LSTAADLWAVVWDTMASGLDKDYLKPDD | (SEQ ID NO: 233) |
| *LSTAADLWAVVWDTMASGLDKDYLKPDD | (SEQ ID NO: 234) |
| LSWAADLWAVVWDTMASGLDKDYLKPDD | (SEQ ID NO: 235) |
| *LSWAADLWAVVWDTMASGLDKDYLKPDD | (SEQ ID NO: 236) |
| LSTAADVWAVVWDTMASGLDKDYLKPDD | (SEQ ID NO: 237) |
| *LSTAADVWAVVWDTMASGLDKDYLKPDD | (SEQ ID NO: 238) |
| LSWAADVWAVVWDTMASGLDKDYLKPDD | (SEQ ID NO: 239) |
| *LSWAADVWAVVWDTMASGLDKDYLKPDD | (SEQ ID NO: 240) |
| LSTAADMQGVVTDWMASGLDKDYLKPDD | (SEQ ID NO: 241) |
| *LSTAADMQGVVTDWMASGLDKDYLKPDD | (SEQ ID NO: 242) |
| LSWAADMQGVVTDWMASGLDKDYLKPDD | (SEQ ID NO: 243) |
| *LSWAADMQGVVTDWMASGLDKDYLKPDD | (SEQ ID NO: 244) |
| LSTAADLQGVVTDWMASGLDKDYLKPDD | (SEQ ID NO: 245) |
| *LSTAADLQGVVTDWMASGLDKDYLKPDD | (SEQ ID NO: 246) |
| LSWAADLQGVVTDWMASGLDKDYLKPDD | (SEQ ID NO: 247) |
| *LSWAADLQGVVTDWMASGLDKDYLKPDD | (SEQ ID NO: 248) |
| LSTAADVQGVVTDWMASGLDKDYLKPDD | (SEQ ID NO: 249) |
| *LSTAADVQGVVTDWMASGLDKDYLKPDD | (SEQ ID NO: 250) |
| LSWAADVQGVVTDWMASGLDKDYLKPDD | (SEQ ID NO: 251) |
| *LSWAADVQGVVTDWMASGLDKDYLKPDD | (SEQ ID NO: 252) |
| LSTAADMWGVVTDWMASGLDKDYLKPDD | (SEQ ID NO: 253) |
| *LSTAADMWGVVTDWMASGLDKDYLKPDD | (SEQ ID NO: 254) |
| LSWAADMWGVVTDWMASGLDKDYLKPDD | (SEQ ID NO: 255) |
| *LSWAADMWGVVTDWMASGLDKDYLKPDD | (SEQ ID NO: 256) |
| LSTAADLWGVVTDWMASGLDKDYLKPDD | (SEQ ID NO: 257) |
| *LSTAADLWGVVTDWMASGLDKDYLKPDD | (SEQ ID NO: 258) |
| LSWAADLWGVVTDWMASGLDKDYLKPDD | (SEQ ID NO: 259) |
| *LSWAADLWGVVTDWMASGLDKDYLKPDD | (SEQ ID NO: 260) |
| LSTAADVWGVVTDWMASGLDKDYLKPDD | (SEQ ID NO: 261) |
| *LSTAADVWGVVTDWMASGLDKDYLKPDD | (SEQ ID NO: 262) |
| LSWAADVWGVVTDWMASGLDKDYLKPDD | (SEQ ID NO: 263) |
| *LSWAADVWGVVTDWMASGLDKDYLKPDD | (SEQ ID NO: 264) |

TABLE 3-continued

| Modified Curedoxin-Derived Peptides | |
|---|---|
| LSTAADMQAVVTDWMASGLDKDYLKPDD | (SEQ ID NO: 265) |
| *LSTAADMQAVVTDWMASGLDKDYLKPDD | (SEQ ID NO: 266) |
| LSWAADMQAVVTDWMASGLDKDYLKPDD | (SEQ ID NO: 267) |
| *LSWAADMQAVVTDWMASGLDKDYLKPDD | (SEQ ID NO: 268) |
| LSTAADLQAVVTDWMASGLDKDYLKPDD | (SEQ ID NO: 269) |
| *LSTAADLQAVVTDWMASGLDKDYLKPDD | (SEQ ID NO: 270) |
| LSWAADLQAVVTDWMASGLDKDYLKPDD | (SEQ ID NO: 271) |
| *LSWAADLQAVVTDWMASGLDKDYLKPDD | (SEQ ID NO: 272) |
| LSTAADVQAVVTDWMASGLDKDYLKPDD | (SEQ ID NO: 273) |
| *LSTAADVQAVVTDWMASGLDKDYLKPDD | (SEQ ID NO: 274) |
| LSWAADVQAVVTDWMASGLDKDYLKPDD | (SEQ ID NO: 275) |
| *LSWAADVQAVVTDWMASGLDKDYLKPDD | (SEQ ID NO: 276) |
| LSTAADMWAVVTDWMASGLDKDYLKPDD | (SEQ ID NO: 277) |
| *LSTAADMWAVVTDWMASGLDKDYLKPDD | (SEQ ID NO: 278) |
| LSWAADMWAVVTDWMASGLDKDYLKPDD | (SEQ ID NO: 279) |
| *LSWAADMWAVVTDWMASGLDKDYLKPDD | (SEQ ID NO: 280) |
| LSTAADLWAVVTDWMASGLDKDYLKPDD | (SEQ ID NO: 281) |
| *LSTAADLWAVVTDWMASGLDKDYLKPDD | (SEQ ID NO: 282) |
| LSWAADLWAVVTDWMASGLDKDYLKPDD | (SEQ ID NO: 283) |
| *LSWAADLWAVVTDWMASGLDKDYLKPDD | (SEQ ID NO: 284) |
| LSTAADVWAVVTDWMASGLDKDYLKPDD | (SEQ ID NO: 285) |
| *LSTAADVWAVVTDWMASGLDKDYLKPDD | (SEQ ID NO: 286) |
| LSWAADVWAVVTDWMASGLDKDYLKPDD | (SEQ ID NO: 287) |
| *LSWAADVWAVVTDWMASGLDKDYLKPDD | (SEQ ID NO: 288) |
| LSTAADMQGVVWDWMASGLDKDYLKPDD | (SEQ ID NO: 289) |
| *LSTAADMQGVVWDWMASGLDKDYLKPDD | (SEQ ID NO: 290) |
| LSWAADMQGVVWDWMASGLDKDYLKPDD | (SEQ ID NO: 291) |
| *LSWAADMQGVVWDWMASGLDKDYLKPDD | (SEQ ID NO: 292) |
| LSTAADLQGVVWDWMASGLDKDYLKPDD | (SEQ ID NO: 293) |
| *LSTAADLQGVVWDWMASGLDKDYLKPDD | (SEQ ID NO: 294) |
| LSWAADLQGVVWDWMASGLDKDYLKPDD | (SEQ ID NO: 295) |
| *LSWAADLQGVVWDWMASGLDKDYLKPDD | (SEQ ID NO: 296) |
| LSTAADVQGVVWDWMASGLDKDYLKPDD | (SEQ ID NO: 297) |
| *LSTAADVQGVVWDWMASGLDKDYLKPDD | (SEQ ID NO: 298) |
| LSWAADVQGVVWDWMASGLDKDYLKPDD | (SEQ ID NO: 299) |
| *LSWAADVQGVVWDWMASGLDKDYLKPDD | (SEQ ID NO: 300) |
| LSTAADMWGVVWDWMASGLDKDYLKPDD | (SEQ ID NO: 301) |
| *LSTAADMWGVVWDWMASGLDKDYLKPDD | (SEQ ID NO: 302) |
| LSWAADMWGVVWDWMASGLDKDYLKPDD | (SEQ ID NO: 303) |

TABLE 3-continued

| Modified Curedoxin-Derived Peptides | |
|---|---|
| *LSWAADMWGVVWDWMASGLDKDYLKPDD | (SEQ ID NO: 304) |
| LSTAADLWGVVWDWMASGLDKDYLKPDD | (SEQ ID NO: 305) |
| *LSTAADLWGVVWDWMASGLDKDYLKPDD | (SEQ ID NO: 306) |
| LSWAADLWGVVWDWMASGLDKDYLKPDD | (SEQ ID NO: 307) |
| *LSWAADLWGVVWDWMASGLDKDYLKPDD | (SEQ ID NO: 308) |
| LSTAADVWGVVWDWMASGLDKDYLKPDD | (SEQ ID NO: 309) |
| *LSTAADVWGVVWDWMASGLDKDYLKPDD | (SEQ ID NO: 310) |
| LSWAADVWGVVWDWMASGLDKDYLKPDD | (SEQ ID NO: 311) |
| *LSWAADVWGVVWDWMASGLDKDYLKPDD | (SEQ ID NO: 312) |
| LSTAADMQAVVWDWMASGLDKDYLKPDD | (SEQ ID NO: 313) |
| *LSTAADMQAVVWDWMASGLDKDYLKPDD | (SEQ ID NO: 314) |
| LSWAADMQAVVWDWMASGLDKDYLKPDD | (SEQ ID NO: 315) |
| *LSWAADMQAVVWDWMASGLDKDYLKPDD | (SEQ ID NO: 316) |
| LSTAADLQAVVWDWMASGLDKDYLKPDD | (SEQ ID NO: 317) |
| *LSTAADLQAVVWDWMASGLDKDYLKPDD | (SEQ ID NO: 318) |
| LSWAADLQAVVWDWMASGLDKDYLKPDD | (SEQ ID NO: 319) |
| *LSWAADLQAVVWDWMASGLDKDYLKPDD | (SEQ ID NO: 320) |
| LSTAADVQAVVWDWMASGLDKDYLKPDD | (SEQ ID NO: 321) |
| *LSTAADVQAVVWDWMASGLDKDYLKPDD | (SEQ ID NO: 322) |
| LSWAADVQAVVWDWMASGLDKDYLKPDD | (SEQ ID NO: 323) |
| *LSWAADVQAVVWDWMASGLDKDYLKPDD | (SEQ ID NO: 324) |
| LSTAADMWAVVWDWMASGLDKDYLKPDD | (SEQ ID NO: 325) |
| *LSTAADMWAVVWDWMASGLDKDYLKPDD | (SEQ ID NO: 326) |
| LSWAADMWAVVWDWMASGLDKDYLKPDD | (SEQ ID NO: 327) |
| *LSWAADMWAVVWDWMASGLDKDYLKPDD | (SEQ ID NO: 328) |
| LSTAADLWAVVWDWMASGLDKDYLKPDD | (SEQ ID NO: 329) |
| *LSTAADLWAVVWDWMASGLDKDYLKPDD | (SEQ ID NO: 330) |
| LSWAADLWAVVWDWMASGLDKDYLKPDD | (SEQ ID NO: 331) |
| *LSWAADLWAVVWDWMASGLDKDYLKPDD | (SEQ ID NO: 332) |
| LSTAADVWAVVWDWMASGLDKDYLKPDD | (SEQ ID NO: 333) |
| *LSTAADVWAVVWDWMASGLDKDYLKPDD | (SEQ ID NO: 334) |
| LSWAADVWAVVWDWMASGLDKDYLKPDD | (SEQ ID NO: 335) |
| *LSWAADVWAVVWDWMASGLDKDYLKPDD | (SEQ ID NO: 336) |
| LSTAADMQGVVTDGLASGLDKDYLKPDD | (SEQ ID NO: 337) |
| *LSTAADMQGVVTDGLASGLDKDYLKPDD | (SEQ ID NO: 338) |
| LSWAADMQGVVTDGLASGLDKDYLKPDD | (SEQ ID NO: 339) |
| *LSWAADMQGVVTDGLASGLDKDYLKPDD | (SEQ ID NO: 340) |
| LSTAADLQGVVTDGLASGLDKDYLKPDD | (SEQ ID NO: 341) |
| *LSTAADLQGVVTDGLASGLDKDYLKPDD | (SEQ ID NO: 342) |

TABLE 3-continued

| Modified Curedoxin-Derived Peptides | |
|---|---|
| LSWAADLQGVVTDGLASGLDKDYLKPDD | (SEQ ID NO: 343) |
| *LSWAADLQGVVTDGLASGLDKDYLKPDD | (SEQ ID NO: 344) |
| LSTAADVQGVVTDGLASGLDKDYLKPDD | (SEQ ID NO: 345) |
| *LSTAADVQGVVTDGLASGLDKDYLKPDD | (SEQ ID NO: 346) |
| LSWAADVQGVVTDGLASGLDKDYLKPDD | (SEQ ID NO: 347) |
| *LSWAADVQGVVTDGLASGLDKDYLKPDD | (SEQ ID NO: 348) |
| LSTAADMWGVVTDGLASGLDKDYLKPDD | (SEQ ID NO: 349) |
| *LSTAADMWGVVTDGLASGLDKDYLKPDD | (SEQ ID NO: 350) |
| LSWAADMWGVVTDGLASGLDKDYLKPDD | (SEQ ID NO: 351) |
| *LSWAADMWGVVTDGLASGLDKDYLKPDD | (SEQ ID NO: 352) |
| LSTAADLWGVVTDGLASGLDKDYLKPDD | (SEQ ID NO: 353) |
| *LSTAADLWGVVTDGLASGLDKDYLKPDD | (SEQ ID NO: 354) |
| LSWAADLWGVVTDGLASGLDKDYLKPDD | (SEQ ID NO: 355) |
| *LSWAADLWGVVTDGLASGLDKDYLKPDD | (SEQ ID NO: 356) |
| LSTAADVWGVVTDGLASGLDKDYLKPDD | (SEQ ID NO: 357) |
| *LSTAADVWGVVTDGLASGLDKDYLKPDD | (SEQ ID NO: 358) |
| LSWAADVWGVVTDGLASGLDKDYLKPDD | (SEQ ID NO: 359) |
| *LSWAADVWGVVTDGLASGLDKDYLKPDD | (SEQ ID NO: 360) |
| LSTAADMQAVVTDGLASGLDKDYLKPDD | (SEQ ID NO: 361) |
| *LSTAADMQAVVTDGLASGLDKDYLKPDD | (SEQ ID NO: 362) |
| LSWAADMQAVVTDGLASGLDKDYLKPDD | (SEQ ID NO: 363) |
| *LSWAADMQAVVTDGLASGLDKDYLKPDD | (SEQ ID NO: 364) |
| LSTAADLQAVVTDGLASGLDKDYLKPDD | (SEQ ID NO: 365) |
| *LSTAADLQAVVTDGLASGLDKDYLKPDD | (SEQ ID NO: 366) |
| LSWAADLQAVVTDGLASGLDKDYLKPDD | (SEQ ID NO: 367) |
| *LSWAADLQAVVTDGLASGLDKDYLKPDD | (SEQ ID NO: 368) |
| LSTAADVQAVVTDGLASGLDKDYLKPDD | (SEQ ID NO: 369) |
| *LSTAADVQAVVTDGLASGLDKDYLKPDD | (SEQ ID NO: 370) |
| LSWAADVQAVVTDGLASGLDKDYLKPDD | (SEQ ID NO: 371) |
| *LSWAADVQAVVTDGLASGLDKDYLKPDD | (SEQ ID NO: 372) |
| LSTAADMWAVVTDGLASGLDKDYLKPDD | (SEQ ID NO: 373) |
| *LSTAADMWAVVTDGLASGLDKDYLKPDD | (SEQ ID NO: 374) |
| LSWAADMWAVVTDGLASGLDKDYLKPDD | (SEQ ID NO: 375) |
| *LSWAADMWAVVTDGLASGLDKDYLKPDD | (SEQ ID NO: 376) |
| LSTAADLWAVVTDGLASGLDKDYLKPDD | (SEQ ID NO: 377) |
| *LSTAADLWAVVTDGLASGLDKDYLKPDD | (SEQ ID NO: 378) |
| LSWAADLWAVVTDGLASGLDKDYLKPDD | (SEQ ID NO: 379) |
| *LSWAADLWAVVTDGLASGLDKDYLKPDD | (SEQ ID NO: 380) |
| LSTAADVWAVVTDGLASGLDKDYLKPDD | (SEQ ID NO: 381) |

TABLE 3-continued

| Modified Curedoxin-Derived Peptides | |
|---|---|
| *LSTAADVWAVVTDGLASGLDKDYLKPDD | (SEQ ID NO: 382) |
| LSWAADVWAVVTDGLASGLDKDYLKPDD | (SEQ ID NO: 383) |
| *LSWAADVWAVVTDGLASGLDKDYLKPDD | (SEQ ID NO: 384) |
| LSTAADMQGVVWDGLASGLDKDYLKPDD | (SEQ ID NO: 385) |
| *LSTAADMQGVVWDGLASGLDKDYLKPDD | (SEQ ID NO: 386) |
| LSWAADMQGVVWDGLASGLDKDYLKPDD | (SEQ ID NO: 387) |
| *LSWAADMQGVVWDGLASGLDKDYLKPDD | (SEQ ID NO: 388) |
| LSTAADLQGVVWDGLASGLDKDYLKPDD | (SEQ ID NO: 389) |
| *LSTAADLQGVVWDGLASGLDKDYLKPDD | (SEQ ID NO: 390) |
| LSWAADLQGVVWDGLASGLDKDYLKPDD | (SEQ ID NO: 391) |
| *LSWAADLQGVVWDGLASGLDKDYLKPDD | (SEQ ID NO: 392) |
| LSTAADVQGVVWDGLASGLDKDYLKPDD | (SEQ ID NO: 393) |
| *LSTAADVQGVVWDGLASGLDKDYLKPDD | (SEQ ID NO: 394) |
| LSWAADVQGVVWDGLASGLDKDYLKPDD | (SEQ ID NO: 395) |
| *LSWAADVQGVVWDGLASGLDKDYLKPDD | (SEQ ID NO: 396) |
| LSTAADMWGVVWDGLASGLDKDYLKPDD | (SEQ ID NO: 397) |
| *LSTAADMWGVVWDGLASGLDKDYLKPDD | (SEQ ID NO: 398) |
| LSWAADMWGVVWDGLASGLDKDYLKPDD | (SEQ ID NO: 399) |
| *LSWAADMWGVVWDGLASGLDKDYLKPDD | (SEQ ID NO: 400) |
| LSTAADLWGVVWDGLASGLDKDYLKPDD | (SEQ ID NO: 401) |
| *LSTAADLWGVVWDGLASGLDKDYLKPDD | (SEQ ID NO: 402) |
| LSWAADLWGVVWDGLASGLDKDYLKPDD | (SEQ ID NO: 403) |
| *LSWAADLWGVVWDGLASGLDKDYLKPDD | (SEQ ID NO: 404) |
| LSTAADVWGVVWDGLASGLDKDYLKPDD | (SEQ ID NO: 405) |
| *LSTAADVWGVVWDGLASGLDKDYLKPDD | (SEQ ID NO: 406) |
| LSWAADVWGVVWDGLASGLDKDYLKPDD | (SEQ ID NO: 407) |
| *LSWAADVWGVVWDGLASGLDKDYLKPDD | (SEQ ID NO: 408) |
| LSTAADMQAVVWDGLASGLDKDYLKPDD | (SEQ ID NO: 409) |
| *LSTAADMQAVVWDGLASGLDKDYLKPDD | (SEQ ID NO: 410) |
| LSWAADMQAVVWDGLASGLDKDYLKPDD | (SEQ ID NO: 411) |
| *LSWAADMQAVVWDGLASGLDKDYLKPDD | (SEQ ID NO: 412) |
| LSTAADLQAVVWDGLASGLDKDYLKPDD | (SEQ ID NO: 413) |
| *LSTAADLQAVVWDGLASGLDKDYLKPDD | (SEQ ID NO: 414) |
| LSWAADLQAVVWDGLASGLDKDYLKPDD | (SEQ ID NO: 415) |
| *LSWAADLQAVVWDGLASGLDKDYLKPDD | (SEQ ID NO: 416) |
| LSTAADVQAVVWDGLASGLDKDYLKPDD | (SEQ ID NO: 417) |
| *LSTAADVQAVVWDGLASGLDKDYLKPDD | (SEQ ID NO: 418) |
| LSWAADVQAVVWDGLASGLDKDYLKPDD | (SEQ ID NO: 419) |
| *LSWAADVQAVVWDGLASGLDKDYLKPDD | (SEQ ID NO: 420) |

TABLE 3-continued

| Modified Curedoxin-Derived Peptides | |
|---|---|
| LSTAADMWAVVWDGLASGLDKDYLKPDD | (SEQ ID NO: 421) |
| *LSTAADMWAVVWDGLASGLDKDYLKPDD | (SEQ ID NO: 422) |
| LSWAADMWAVVWDGLASGLDKDYLKPDD | (SEQ ID NO: 423) |
| *LSWAADMWAVVWDGLASGLDKDYLKPDD | (SEQ ID NO: 424) |
| LSTAADLWAVVWDGLASGLDKDYLKPDD | (SEQ ID NO: 425) |
| *LSTAADLWAVVWDGLASGLDKDYLKPDD | (SEQ ID NO: 426) |
| LSWAADLWAVVWDGLASGLDKDYLKPDD | (SEQ ID NO: 427) |
| *LSWAADLWAVVWDGLASGLDKDYLKPDD | (SEQ ID NO: 428) |
| LSTAADVWAVVWDGLASGLDKDYLKPDD | (SEQ ID NO: 429) |
| *LSTAADVWAVVWDGLASGLDKDYLKPDD | (SEQ ID NO: 430) |
| LSWAADVWAVVWDGLASGLDKDYLKPDD | (SEQ ID NO: 431) |
| *LSWAADVWAVVWDGLASGLDKDYLKPDD | (SEQ ID NO: 432) |
| LSTAADMQGVVTDTLASGLDKDYLKPDD | (SEQ ID NO: 433) |
| *LSTAADMQGVVTDTLASGLDKDYLKPDD | (SEQ ID NO: 434) |
| LSWAADMQGVVTDTLASGLDKDYLKPDD | (SEQ ID NO: 435) |
| *LSWAADMQGVVTDTLASGLDKDYLKPDD | (SEQ ID NO: 436) |
| LSTAADLQGVVTDTLASGLDKDYLKPDD | (SEQ ID NO: 437) |
| *LSTAADLQGVVTDTLASGLDKDYLKPDD | (SEQ ID NO: 438) |
| LSWAADLQGVVTDTLASGLDKDYLKPDD | (SEQ ID NO: 439) |
| *LAWAADLQGVVTDTLASGLDKDYLKPDD | (SEQ ID NO: 440) |
| LSTAADVQGVVTDTLASGLDKDYLKPDD | (SEQ ID NO: 441) |
| *LSTAADVQGVVTDTLASGLDKDYLKPDD | (SEQ ID NO: 442) |
| LSWAADVQGVVTDTLASGLDKDYLKPDD | (SEQ ID NO: 443) |
| *LSWAADVQGVVTDTLASGLDKDYLKPDD | (SEQ ID NO: 444) |
| LSTAADMWGVVTDTLASGLDKDYLKPDD | (SEQ ID NO: 445) |
| *LSTAADMWGVVTDTLASGLDKDYLKPDD | (SEQ ID NO: 446) |
| LSWAADMWGVVTDTLASGLDKDYLKPDD | (SEQ ID NO: 447) |
| *LSWAADMWGVVTDTLASGLDKDYLKPDD | (SEQ ID NO: 448) |
| LSTAADLWGVVTDTLASGLDKDYLKPDD | (SEQ ID NO: 449) |
| *LSTAADLWGVVTDTLASGLDKDYLKPDD | (SEQ ID NO: 450) |
| LSWAADLWGVVTDTLASGLDKDYLKPDD | (SEQ ID NO: 451) |
| *LSWAADLWGVVTDTLASGLDKDYLKPDD | (SEQ ID NO: 452) |
| LSTAADVWGVVTDTLASGLDKDYLKPDD | (SEQ ID NO: 453) |
| *LSTAADVWGVVTDTLASGLDKDYLKPDD | (SEQ ID NO: 454) |
| LSWAADVWGVVTDTLASGLDKDYLKPDD | (SEQ ID NO: 455) |
| *LSWAADVWGVVTDTLASGLDKDYLKPDD | (SEQ ID NO: 456) |
| LSTAADMQAVVTDTLASGLDKDYLKPDD | (SEQ ID NO: 457) |
| *LSTAADMQAVVTDTLASGLDKDYLKPDD | (SEQ ID NO: 458) |
| LSWAADMQAVVTDTLASGLDKDYLKPDD | (SEQ ID NO: 459) |

TABLE 3-continued

| Modified Curedoxin-Derived Peptides | |
|---|---|
| *LSWAADMQAVVTDTLASGLDKDYLKPDD | (SEQ ID NO: 460) |
| LSTAADLQAVVTDTLASGLDKDYLKPDD | (SEQ ID NO: 461) |
| *LSTAADLQAVVTDTLASGLDKDYLKPDD | (SEQ ID NO: 462) |
| LSWAADLQAVVTDTLASGLDKDYLKPDD | (SEQ ID NO: 463) |
| *LSWAADLQAVVTDTLASGLDKDYLKPDD | (SEQ ID NO: 464) |
| LSTAADVQAVVTDTLASGLDKDYLKPDD | (SEQ ID NO: 465) |
| *LSTAADVQAVVTDTLASGLDKDYLKPDD | (SEQ ID NO: 466) |
| LSWAADVQAVVTDTLASGLDKDYLKPDD | (SEQ ID NO: 467) |
| *LSWAADVQAVVTDTLASGLDKDYLKPDD | (SEQ ID NO: 468) |
| LSTAADMWAVVTDTLASGLDKDYLKPDD | (SEQ ID NO: 469) |
| *LSTAADMWAVVTDTLASGLDKDYLKPDD | (SEQ ID NO: 470) |
| LSWAADMWAVVTDTLASGLDKDYLKPDD | (SEQ ID NO: 471) |
| *LSWAADMWAVVTDTLASGLDKDYLKPDD | (SEQ ID NO: 472) |
| LSTAADLWAVVTDTLASGLDKDYLKPDD | (SEQ ID NO: 473) |
| *LSTAADLWAVVTDTLASGLDKDYLKPDD | (SEQ ID NO: 474) |
| LSWAADLWAVVTDTLASGLDKDYLKPDD | (SEQ ID NO: 475) |
| *LSWAADLWAVVTDTLASGLDKDYLKPDD | (SEQ ID NO: 476) |
| LSTAADVWAVVTDTLASGLDKDYLKPDD | (SEQ ID NO: 477) |
| *LSTAADVWAVVTDTLASGLDKDYLKPDD | (SEQ ID NO: 478) |
| LSWAADVWAVVTDTLASGLDKDYLKPDD | (SEQ ID NO: 479) |
| *LSWAADVWAVVTDTLASGLDKDYLKPDD | (SEQ ID NO: 480) |
| LSTAADMQGVVWDTLASGLDKDYLKPDD | (SEQ ID NO: 481) |
| *LSTAADMQGVVWDTLASGLDKDYLKPDD | (SEQ ID NO: 482) |
| LSWAADMQGVVWDTLASGLDKDYLKPDD | (SEQ ID NO: 483) |
| *LSWAADMQGVVWDTLASGLDKDYLKPDD | (SEQ ID NO: 484) |
| LSTAADLQGVVWDTLASGLDKDYLKPDD | (SEQ ID NO: 485) |
| *LSTAADLQGVVWDTLASGLDKDYLKPDD | (SEQ ID NO: 486) |
| LSWAADLQGVVWDTLASGLDKDYLKPDD | (SEQ ID NO: 487) |
| *LSWAADLQGVVWDTLASGLDKDYLKPDD | (SEQ ID NO: 488) |
| LSTAADVQGVVWDTLASGLDKDYLKPDD | (SEQ ID NO: 489) |
| *LSTAADVQGVVWDTLASGLDKDYLKPDD | (SEQ ID NO: 490) |
| LSWAADVQGVVWDTLASGLDKDYLKPDD | (SEQ ID NO: 491) |
| *LSWAADVQGVVWDTLASGLDKDYLKPDD | (SEQ ID NO: 492) |
| LSTAADMWGVVWDTLASGLDKDYLKPDD | (SEQ ID NO: 493) |
| *LSTAADMWGVVWDTLASGLDKDYLKPDD | (SEQ ID NO: 494) |
| LSWAADMWGVVWDTLASGLDKDYLKPDD | (SEQ ID NO: 495) |
| *LSWAADMWGVVWDTLASGLDKDYLKPDD | (SEQ ID NO: 496) |
| LSTAADLWGVVWDTLASGLDKDYLKPDD | (SEQ ID NO: 497) |
| *LSTAADLWGVVWDTLASGLDKDYLKPDD | (SEQ ID NO: 498) |

TABLE 3-continued

| Modified Curedoxin-Derived Peptides | |
|---|---|
| LSWAADLWGVVWDTLASGLDKDYLKPDD | (SEQ ID NO: 499) |
| *LSWAADLWGVVWDTLASGLDKDYLKPDD | (SEQ ID NO: 500) |
| LSTAADVWGVVWDTLASGLDKDYLKPDD | (SEQ ID NO: 501) |
| *LSTAADVWGVVWDTLASGLDKDYLKPDD | (SEQ ID NO: 502) |
| LSWAADVWGVVWDTLASGLDKDYLKPDD | (SEQ ID NO: 503) |
| *LSWAADVWGVVWDTLASGLDKDYLKPDD | (SEQ ID NO: 504) |
| LSTAADMQAVVWDTLASGLDKDYLKPDD | (SEQ ID NO: 505) |
| *LSTAADMQAVVWDTLASGLDKDYLKPDD | (SEQ ID NO: 506) |
| LSWAADMQAVVWDTLASGLDKDYLKPDD | (SEQ ID NO: 507) |
| *LSWAADMQAVVWDTLASGLDKDYLKPDD | (SEQ ID NO: 508) |
| LSTAADLQAVVWDTLASGLDKDYLKPDD | (SEQ ID NO: 509) |
| *LSTAADLQAVVWDTLASGLDKDYLKPDD | (SEQ ID NO: 510) |
| LSWAADLQAVVWDTLASGLDKDYLKPDD | (SEQ ID NO: 511) |
| *LSWAADLQAVVWDTLASGLDKDYLKPDD | (SEQ ID NO: 512) |
| LSTAADVQAVVWDTLASGLDKDYLKPDD | (SEQ ID NO: 513) |
| *LSTAADVQAVVWDTLASGLDKDYLKPDD | (SEQ ID NO: 514) |
| LSWAADVQAVVWDTLASGLDKDYLKPDD | (SEQ ID NO: 515) |
| *LSWAADVQAVVWDTLASGLDKDYLKPDD | (SEQ ID NO: 516) |
| LSTAADMWAVVWDTLASGLDKDYLKPDD | (SEQ ID NO: 517) |
| *LSTAADMWAVVWDTLASGLDKDYLKPDD | (SEQ ID NO: 518) |
| LSWAADMWAVVWDTLASGLDKDYLKPDD | (SEQ ID NO: 519) |
| *LSWAADMWAVVWDTLASGLDKDYLKPDD | (SEQ ID NO: 520) |
| LSTAADLWAVVWDTLASGLDKDYLKPDD | (SEQ ID NO: 521) |
| *LSTAADLWAVVWDTLASGLDKDYLKPDD | (SEQ ID NO: 522) |
| LSWAADLWAVVWDTLASGLDKDYLKPDD | (SEQ ID NO: 523) |
| *LSWAADLWAVVWDTLASGLDKDYLKPDD | (SEQ ID NO: 524) |
| LSTAADVWAVVWDTLASGLDKDYLKPDD | (SEQ ID NO: 525) |
| *LSTAADVWAVVWDTLASGLDKDYLKPDD | (SEQ ID NO: 526) |
| LSWAADVWAVVWDTLASGLDKDYLKPDD | (SEQ ID NO: 527) |
| *LSWAADVWAVVWDTLASGLDKDYLKPDD | (SEQ ID NO: 528) |
| LSTAADMQGVVTDWLASGLDKDYLKPDD | (SEQ ID NO: 529) |
| *LSTAADMQGVVTDWLASGLDKDYLKPDD | (SEQ ID NO: 530) |
| LSWAADMQGVVTDWLASGLDKDYLKPDD | (SEQ ID NO: 531) |
| *LSWAADMQGVVTDWLASGLDKDYLKPDD | (SEQ ID NO: 532) |
| LSTAADLQGVVTDWLASGLDKDYLKPDD | (SEQ ID NO: 533) |
| *LSTAADLQGVVTDWLASGLDKDYLKPDD | (SEQ ID NO: 534) |
| LSWAADLQGVVTDWLASGLDKDYLKPDD | (SEQ ID NO: 535) |
| *LSWAADLQGVVTDWLASGLDKDYLKPDD | (SEQ ID NO: 536) |
| LSTAADVQGVVTDWLASGLDKDYLKPDD | (SEQ ID NO: 537) |

TABLE 3-continued

| Modified Curedoxin-Derived Peptides | |
|---|---|
| *LSTAADVQGVVTDWLASGLDKDYLKPDD | (SEQ ID NO: 538) |
| LSWAADVQGVVTDWLASGLDKDYLKPDD | (SEQ ID NO: 539) |
| *LSWAADVQGVVTDWLASGLDKDYLKPDD | (SEQ ID NO: 540) |
| LSTAADMWGVVTDWLASGLDKDYLKPDD | (SEQ ID NO: 541) |
| *LSTAADMWGVVTDWLASGLDKDYLKPDD | (SEQ ID NO: 542) |
| LSWAADMWGVVTDWLASGLDKDYLKPDD | (SEQ ID NO: 543) |
| *LSWAADMWGVVTDWLASGLDKDYLKPDD | (SEQ ID NO: 544) |
| LSTAADLWGVVTDWLASGLDKDYLKPDD | (SEQ ID NO: 545) |
| *LSTAADLWGVVTDWLASGLDKDYLKPDD | (SEQ ID NO: 546) |
| LSWAADLWGVVTDWLASGLDKDYLKPDD | (SEQ ID NO: 547) |
| *LSWAADLWGVVTDWLASGLDKDYLKPDD | (SEQ ID NO: 548) |
| LSTAADVWGVVTDWLASGLDKDYLKPDD | (SEQ ID NO: 549) |
| *LSTAADVWGVVTDWLASGLDKDYLKPDD | (SEQ ID NO: 550) |
| LSWAADVWGVVTDWLASGLDKDYLKPDD | (SEQ ID NO: 551) |
| *LSWAADVWGVVTDWLASGLDKDYLKPDD | (SEQ ID NO: 552) |
| LSTAADMQAVVTDWLASGLDKDYLKPDD | (SEQ ID NO: 553) |
| *LSTAADMQAVVTDWLASGLDKDYLKPDD | (SEQ ID NO: 554) |
| LSWAADMQAVVTDWLASGLDKDYLKPDD | (SEQ ID NO: 555) |
| *LSWAADMQAVVTDWLASGLDKDYLKPDD | (SEQ ID NO: 556) |
| LSTAADLQAVVTDWLASGLDKDYLKPDD | (SEQ ID NO: 557) |
| *LSTAADLQAVVTDWLASGLDKDYLKPDD | (SEQ ID NO: 558) |
| LSWAADLQAVVTDWLASGLDKDYLKPDD | (SEQ ID NO: 559) |
| *LSWAADLQAVVTDWLASGLDKDYLKPDD | (SEQ ID NO: 560) |
| LSTAADVQAVVTDWLASGLDKDYLKPDD | (SEQ ID NO: 561) |
| *LSTAADVQAVVTDWLASGLDKDYLKPDD | (SEQ ID NO: 562) |
| LSWAADVQAVVTDWLASGLDKDYLKPDD | (SEQ ID NO: 563) |
| *LSWAADVQAVVTDWLASGLDKDYLKPDD | (SEQ ID NO: 564) |
| LSTAADMWAVVTDWLASGLDKDYLKPDD | (SEQ ID NO: 565) |
| *LSTAADMWAVVTDWLASGLDKDYLKPDD | (SEQ ID NO: 566) |
| LSWAADMWAVVTDWLASGLDKDYLKPDD | (SEQ ID NO: 567) |
| *LSWAADMWAVVTDWLASGLDKDYLKPDD | (SEQ ID NO: 568) |
| LSTAADLWAVVTDWLASGLDKDYLKPDD | (SEQ ID NO: 569) |
| *LSTAADLWAVVTDWLASGLDKDYLKPDD | (SEQ ID NO: 570) |
| LSWAADLWAVVTDWLASGLDKDYLKPDD | (SEQ ID NO: 571) |
| *LSWAADLWAVVTDWLASGLDKDYLKPDD | (SEQ ID NO: 572) |
| LSTAADVWAVVTDWLASGLDKDYLKPDD | (SEQ ID NO: 573) |
| *LSTAADVWAVVTDWLASGLDKDYLKPDD | (SEQ ID NO: 574) |
| LSWAADVWAVVTDWLASGLDKDYLKPDD | (SEQ ID NO: 575) |
| *LSWAADVWAVVTDWLASGLDKDYLKPDD | (SEQ ID NO: 576) |

TABLE 3-continued

| Modified Curedoxin-Derived Peptides | |
| --- | --- |
| LSTAADMQGVVWDWLASGLDKDYLKPDD | (SEQ ID NO: 577) |
| *LSTAADMQGVVWDWLASGLDKDYLKPDD | (SEQ ID NO: 578) |
| LSWAADMQGVVWDWLASGLDKDYLKPDD | (SEQ ID NO: 579) |
| *LSWAADMQGVVWDWLASGLDKDYLKPDD | (SEQ ID NO: 580) |
| LSTAADLQGVVWDWLASGLDKDYLKPDD | (SEQ ID NO: 581) |
| *LSTAADLQGVVWDWLASGLDKDYLKPDD | (SEQ ID NO: 582) |
| LSWAADLQGVVWDWLASGLDKDYLKPDD | (SEQ ID NO: 583) |
| *LSWAADLQGVVWDWLASGLDKDYLKPDD | (SEQ ID NO: 584) |
| LSTAADVQGVVWDWLASGLDKDYLKPDD | (SEQ ID NO: 585) |
| *LSTAADVQGVVWDWLASGLDKDYLKPDD | (SEQ ID NO: 586) |
| LSWAADVQGVVWDWLASGLDKDYLKPDD | (SEQ ID NO: 587) |
| *LSWAADVQGVVWDWLASGLDKDYLKPDD | (SEQ ID NO: 588) |
| LSTAADMWGVVWDWLASGLDKDYLKPDD | (SEQ ID NO: 589) |
| *LSTAADMWGVVWDWLASGLDKDYLKPDD | (SEQ ID NO: 590) |
| LSWAADMWGVVWDWLASGLDKDYLKPDD | (SEQ ID NO: 591) |
| *LSWAADMWGVVWDWLASGLDKDYLKPDD | (SEQ ID NO: 592) |
| LSTAADLWGVVWDWLASGLDKDYLKPDD | (SEQ ID NO: 593) |
| *LSTAADLWGVVWDWLASGLDKDYLKPDD | (SEQ ID NO: 594) |
| LSWAADLWGVVWDWLASGLDKDYLKPDD | (SEQ ID NO: 595) |
| *LSWAADLWGVVWDWLASGLDKDYLKPDD | (SEQ ID NO: 596) |
| LSTAADVWGVVWDWLASGLDKDYLKPDD | (SEQ ID NO: 597) |
| *LSTAADVWGVVWDWLASGLDKDYLKPDD | (SEQ ID NO: 598) |
| LSWAADVWGVVWDWLASGLDKDYLKPDD | (SEQ ID NO: 599) |
| *LSWAADVWGVVWDWLASGLDKDYLKPDD | (SEQ ID NO: 600) |
| LSTAADMQAVVWDWLASGLDKDYLKPDD | (SEQ ID NO: 601) |
| *LSTAADMQAVVWDWLASGLDKDYLKPDD | (SEQ ID NO: 602) |
| LSWAADMQAVVWDWLASGLDKDYLKPDD | (SEQ ID NO: 603) |
| *LSWAADMQAVVWDWLASGLDKDYLKPDD | (SEQ ID NO: 604) |
| LSTAADLQAVVWDWLASGLDKDYLKPDD | (SEQ ID NO: 605) |
| *LSTAADLQAVVWDWLASGLDKDYLKPDD | (SEQ ID NO: 606) |
| LSWAADLQAVVWDWLASGLDKDYLKPDD | (SEQ ID NO: 607) |
| *LSWAADLQAVVWDWLASGLDKDYLKPDD | (SEQ ID NO: 608) |
| LSTAADVQAVVWDWLASGLDKDYLKPDD | (SEQ ID NO: 609) |
| *LSTAADVQAVVWDWLASGLDKDYLKPDD | (SEQ ID NO: 610) |
| LSWAADVQAVVWDWLASGLDKDYLKPDD | (SEQ ID NO: 611) |
| *LSWAADVQAVVWDWLASGLDKDYLKPDD | (SEQ ID NO: 612) |
| LSTAADMWAVVWDWLASGLDKDYLKPDD | (SEQ ID NO: 613) |
| *LSTAADMWAVVWDWLASGLDKDYLKPDD | (SEQ ID NO: 614) |
| LSWAADMWAVVWDWLASGLDKDYLKPDD | (SEQ ID NO: 615) |

TABLE 3-continued

| Modified Curedoxin-Derived Peptides | |
| --- | --- |
| *LSWAADMWAVVWDWLASGLDKDYLKPDD | (SEQ ID NO: 616) |
| LSTAADLWAVVWDWLASGLDKDYLKPDD | (SEQ ID NO: 617) |
| *LSTAADLWAVVWDWLASGLDKDYLKPDD | (SEQ ID NO: 618) |
| LSWAADLWAVVWDWLASGLDKDYLKPDD | (SEQ ID NO: 619) |
| *LSWAADLWAVVWDWLASGLDKDYLKPDD | (SEQ ID NO: 620) |
| LSTAADVWAVVWDWLASGLDKDYLKPDD | (SEQ ID NO: 621) |
| *LSTAADVWAVVWDWLASGLDKDYLKPDD | (SEQ ID NO: 622) |
| LSWAADVWAVVWDWLASGLDKDYLKPDD | (SEQ ID NO: 623) |
| *LSWAADVWAVVWDWLASGLDKDYLKPDD | (SEQ ID NO: 624) |
| LSTAADMQGVVTDGVASGLDKDYLKPDD | (SEQ ID NO: 625) |
| *LSTAADMQGVVTDGVASGLDKDYLKPDD | (SEQ ID NO: 626) |
| LSWAADMQGVVTDGVASGLDKDYLKPDD | (SEQ ID NO: 627) |
| *LSWAADMQGVVTDGVASGLDKDYLKPDD | (SEQ ID NO: 628) |
| LSTAADLQGVVTDGVASGLDKDYLKPDD | (SEQ ID NO: 629) |
| *LSTAADLQGVVTDGVASGLDKDYLKPDD | (SEQ ID NO: 630) |
| LSWAADLQGVVTDGVASGLDKDYLKPDD | (SEQ ID NO: 631) |
| *LSWAADLQGVVTDGVASGLDKDYLKPDD | (SEQ ID NO: 632) |
| LSTAADVQGVVTDGVASGLDKDYLKPDD | (SEQ ID NO: 633) |
| *LSTAADVQGVVTDGVASGLDKDYLKPDD | (SEQ ID NO: 634) |
| LSWAADVQGVVTDGVASGLDKDYLKPDD | (SEQ ID NO: 635) |
| *LSWAADVQGVVTDGVASGLDKDYLKPDD | (SEQ ID NO: 636) |
| LSTAADMWGVVTDGVASGLDKDYLKPDD | (SEQ ID NO: 637) |
| *LSTAADMWGVVTDGVASGLDKDYLKPDD | (SEQ ID NO: 638) |
| LSWAADMWGVVTDGVASGLDKDYLKPDD | (SEQ ID NO: 639) |
| *LSWAADMWGVVTDGVASGLDKDYLKPDD | (SEQ ID NO: 640) |
| LSTAADLWGVVTDGVASGLDKDYLKPDD | (SEQ ID NO: 641) |
| *LSTAADLWGVVTDGVASGLDKDYLKPDD | (SEQ ID NO: 642) |
| LSWAADLWGVVTDGVASGLDKDYLKPDD | (SEQ ID NO: 643) |
| *LSWAADLWGVVTDGVASGLDKDYLKPDD | (SEQ ID NO: 644) |
| LSTAADVWGVVTDGVASGLDKDYLKPDD | (SEQ ID NO: 645) |
| *LSTAADVWGVVTDGVASGLDKDYLKPDD | (SEQ ID NO: 646) |
| LSWAADVWGVVTDGVASGLDKDYLKPDD | (SEQ ID NO: 647) |
| *LSWAADVWGVVTDGVASGLDKDYLKPDD | (SEQ ID NO: 648) |
| LSTAADMQAVVTDGVASGLDKDYLKPDD | (SEQ ID NO: 649) |
| *LSTAADMQAVVTDGVASGLDKDYLKPDD | (SEQ ID NO: 650) |
| LSWAADMQAVVTDGVASGLDKDYLKPDD | (SEQ ID NO: 651) |
| *LSWAADMQAVVTDGVASGLDKDYLKPDD | (SEQ ID NO: 652) |
| LSTAADLQAVVTDGVASGLDKDYLKPDD | (SEQ ID NO: 653) |
| *LSTAADLQAVVTDGVASGLDKDYLKPDD | (SEQ ID NO: 654) |

TABLE 3-continued

| Modified Curedoxin-Derived Peptides | |
|---|---|
| LSWAADLQAVVTDGVASGLDKDYLKPDD | (SEQ ID NO: 655) |
| *LSWAADLQAVVTDGVASGLDKDYLKPDD | (SEQ ID NO: 656) |
| LSTAADVQAVVTDGVASGLDKDYLKPDD | (SEQ ID NO: 657) |
| *LSTAADVQAVVTDGVASGLDKDYLKPDD | (SEQ ID NO: 658) |
| LSWAADVQAVVTDGVASGLDKDYLKPDD | (SEQ ID NO: 659) |
| *LSWAADVQAVVTDGVASGLDKDYLKPDD | (SEQ ID NO: 660) |
| LSTAADMWAVVTDGVASGLDKDYLKPDD | (SEQ ID NO: 661) |
| *LSTAADMWAVVTDGVASGLDKDYLKPDD | (SEQ ID NO: 662) |
| LSWAADMWAVVTDGVASGLDKDYLKPDD | (SEQ ID NO: 663) |
| *LSWAADMWAVVTDGVASGLDKDYLKPDD | (SEQ ID NO: 664) |
| LSTAADLWAVVTDGVASGLDKDYLKPDD | (SEQ ID NO: 665) |
| *LSTAADLWAVVTDGVASGLDKDYLKPDD | (SEQ ID NO: 666) |
| LSWAADLWAVVTDGVASGLDKDYLKPDD | (SEQ ID NO: 667) |
| *LSWAADLWAVVTDGVASGLDKDYLKPDD | (SEQ ID NO: 668) |
| LSTAADVWAVVTDGVASGLDKDYLKPDD | (SEQ ID NO: 669) |
| *LSTAADVWAVVTDGVASGLDKDYLKPDD | (SEQ ID NO: 670) |
| LSWAADVWAVVTDGVASGLDKDYLKPDD | (SEQ ID NO: 671) |
| *LSWAADVWAVVTDGVASGLDKDYLKPDD | (SEQ ID NO: 672) |
| LSTAADMQGVVWDGVASGLDKDYLKPDD | (SEQ ID NO: 673) |
| *LSTAADMQGVVWDGVASGLDKDYLKPDD | (SEQ ID NO: 674) |
| LSWAADMQGVVWDGVASGLDKDYLKPDD | (SEQ ID NO: 675) |
| *LSWAADMQGVVWDGVASGLDKDYLKPDD | (SEQ ID NO: 676) |
| LSTAADLQGVVWDGVASGLDKDYLKPDD | (SEQ ID NO: 677) |
| *LSTAADLQGVVWDGVASGLDKDYLKPDD | (SEQ ID NO: 678) |
| LSWAADLQGVVWDGVASGLDKDYLKPDD | (SEQ ID NO: 679) |
| *LSWAADLQGVVWDGVASGLDKDYLKPDD | (SEQ ID NO: 680) |
| LSTAADVQGVVWDGVASGLDKDYLKPDD | (SEQ ID NO: 681) |
| *LSTAADVQGVVWDGVASGLDKDYLKPDD | (SEQ ID NO: 682) |
| LSWAADVQGVVWDGVASGLDKDYLKPDD | (SEQ ID NO: 683) |
| *LSWAADVQGVVWDGVASGLDKDYLKPDD | (SEQ ID NO: 684) |
| LSTAADMWGVVWDGVASGLDKDYLKPDD | (SEQ ID NO: 685) |
| *LSTAADMWGVVWDGVASGLDKDYLKPDD | (SEQ ID NO: 686) |
| LSWAADMWGVVWDGVASGLDKDYLKPDD | (SEQ ID NO: 687) |
| *LSWAADMWGVVWDGVASGLDKDYLKPDD | (SEQ ID NO: 688) |
| LSTAADLWGVVWDGVASGLDKDYLKPDD | (SEQ ID NO: 689) |
| *LSTAADLWGVVWDGVASGLDKDYLKPDD | (SEQ ID NO: 690) |
| LSWAADLWGVVWDGVASGLDKDYLKPDD | (SEQ ID NO: 691) |
| *LSWAADLWGVVWDGVASGLDKDYLKPDD | (SEQ ID NO: 692) |
| LSTAADVWGVVWDGVASGLDKDYLKPDD | (SEQ ID NO: 693) |

TABLE 3-continued

| Modified Curedoxin-Derived Peptides | |
|---|---|
| *LSTAADVWGVVWDGVASGLDKDYLKPDD | (SEQ ID NO: 694) |
| LSWAADVWGVVWDGVASGLDKDYLKPDD | (SEQ ID NO: 695) |
| *LSWAADVWGVVWDGVASGLDKDYLKPDD | (SEQ ID NO: 696) |
| LSTAADMQAVVWDGVASGLDKDYLKPDD | (SEQ ID NO: 697) |
| *LSTAADMQAVVWDGVASGLDKDYLKPDD | (SEQ ID NO: 698) |
| LSWAADMQAVVWDGVASGLDKDYLKPDD | (SEQ ID NO: 699) |
| *LSWAADMQAVVWDGVASGLDKDYLKPDD | (SEQ ID NO: 700) |
| LSTAADLQAVVWDGVASGLDKDYLKPDD | (SEQ ID NO: 701) |
| *LSTAADLQAVVWDGVASGLDKDYLKPDD | (SEQ ID NO: 702) |
| LSWAADLQAVVWDGVASGLDKDYLKPDD | (SEQ ID NO: 703) |
| *LSWAADLQAVVWDGVASGLDKDYLKPDD | (SEQ ID NO: 704) |
| LSTAADVQAVVWDGVASGLDKDYLKPDD | (SEQ ID NO: 705) |
| *LSTAADVQAVVWDGVASGLDKDYLKPDD | (SEQ ID NO: 706) |
| LSWAADVQAVVWDGVASGLDKDYLKPDD | (SEQ ID NO: 707) |
| *LSWAADVQAVVWDGVASGLDKDYLKPDD | (SEQ ID NO: 708) |
| LSTAADMWAVVWDGVASGLDKDYLKPDD | (SEQ ID NO: 709) |
| *LSTAADMWAVVWDGVASGLDKDYLKPDD | (SEQ ID NO: 710) |
| LSWAADMWAVVWDGVASGLDKDYLKPDD | (SEQ ID NO: 711) |
| *LSWAADMWAVVWDGVASGLDKDYLKPDD | (SEQ ID NO: 712) |
| LSTAADLWAVVWDGVASGLDKDYLKPDD | (SEQ ID NO: 713) |
| *LSTAADLWAVVWDGVASGLDKDYLKPDD | (SEQ ID NO: 714) |
| LSWAADLWAVVWDGVASGLDKDYLKPDD | (SEQ ID NO: 715) |
| *LSWAADLWAVVWDGVASGLDKDYLKPDD | (SEQ ID NO: 716) |
| LSTAADVWAVVWDGVASGLDKDYLKPDD | (SEQ ID NO: 717) |
| *LSTAADVWAVVWDGVASGLDKDYLKPDD | (SEQ ID NO: 718) |
| LSWAADVWAVVWDGVASGLDKDYLKPDD | (SEQ ID NO: 719) |
| *LSWAADVWAVVWDGVASGLDKDYLKPDD | (SEQ ID NO: 720) |
| LSTAADMQGVVTDTVASGLDKDYLKPDD | (SEQ ID NO: 721) |
| *LSTAADMQGVVTDTVASGLDKDYLKPDD | (SEQ ID NO: 722) |
| LSWAADMQGVVTDTVASGLDKDYLKPDD | (SEQ ID NO: 723) |
| *LSWAADMQGVVTDTVASGLDKDYLKPDD | (SEQ ID NO: 724) |
| LSTAADLQGVVTDTVASGLDKDYLKPDD | (SEQ ID NO: 725) |
| *LSTAADLQGVVTDTVASGLDKDYLKPDD | (SEQ ID NO: 726) |
| LSWAADLQGVVTDTVASGLDKDYLKPDD | (SEQ ID NO: 727) |
| *LSWAADLQGVVTDTVASGLDKDYLKPDD | (SEQ ID NO: 728) |
| LSTAADVQGVVTDTVASGLDKDYLKPDD | (SEQ ID NO: 729) |
| *LSTAADVQGVVTDTVASGLDKDYLKPDD | (SEQ ID NO: 730) |
| LSWAADVQGVVTDTVASGLDKDYLKPDD | (SEQ ID NO: 731) |
| *LSWAADVQGVVTDTVASGLDKDYLKPDD | (SEQ ID NO: 732) |

TABLE 3-continued

| Modified Curedoxin-Derived Peptides | |
|---|---|
| LSTAADMWGVVTDTVASGLDKDYLKPDD | (SEQ ID NO: 733) |
| *LSTAADMWGVVTDTVASGLDKDYLKPDD | (SEQ ID NO: 734) |
| LSWAADMWGVVTDTVASGLDKDYLKPDD | (SEQ ID NO: 735) |
| *LSWAADMWGVVTDTVASGLDKDYLKPDD | (SEQ ID NO: 736) |
| LSTAADLWGVVTDTVASGLDKDYLKPDD | (SEQ ID NO: 737) |
| *LSTAADLWGVVTDTVASGLDKDYLKPDD | (SEQ ID NO: 738) |
| LSWAADLWGVVTDTVASGLDKDYLKPDD | (SEQ ID NO: 739) |
| *LSWAADLWGVVTDTVASGLDKDYLKPDD | (SEQ ID NO: 740) |
| LSTAADVWGVVTDTVASGLDKDYLKPDD | (SEQ ID NO: 741) |
| *LSTAADVWGVVTDTVASGLDKDYLKPDD | (SEQ ID NO: 742) |
| LSWAADVWGVVTDTVASGLDKDYLKPDD | (SEQ ID NO: 743) |
| *LSWAADVWGVVTDTVASGLDKDYLKPDD | (SEQ ID NO: 744) |
| LSTAADMQAVVTDTVASGLDKDYLKPDD | (SEQ ID NO: 745) |
| *LSTAADMQAVVTDTVASGLDKDYLKPDD | (SEQ ID NO: 746) |
| LSWAADMQAVVTDTVASGLDKDYLKPDD | (SEQ ID NO: 747) |
| *LSWAADMQAVVTDTVASGLDKDYLKPDD | (SEQ ID NO: 748) |
| LSTAADLQAVVTDTVASGLDKDYLKPDD | (SEQ ID NO: 749) |
| *LSTAADLQAVVTDTVASGLDKDYLKPDD | (SEQ ID NO: 750) |
| LSWAADLQAVVTDTVASGLDKDYLKPDD | (SEQ ID NO: 751) |
| *LSWAADLQAVVTDTVASGLDKDYLKPDD | (SEQ ID NO: 752) |
| LSTAADVQAVVTDTVASGLDKDYLKPDD | (SEQ ID NO: 753) |
| *LSTAADVQAVVTDTVASGLDKDYLKPDD | (SEQ ID NO: 754) |
| LSWAADVQAVVTDTVASGLDKDYLKPDD | (SEQ ID NO: 755) |
| *LSWAADVQAVVTDTVASGLDKDYLKPDD | (SEQ ID NO: 756) |
| LSTAADMWAVVTDTVASGLDKDYLKPDD | (SEQ ID NO: 757) |
| *LSTAADMWAVVTDTVASGLDKDYLKPDD | (SEQ ID NO: 758) |
| LSWAADMWAVVTDTVASGLDKDYLKPDD | (SEQ ID NO: 759) |
| *LSWAADMWAVVTDTVASGLDKDYLKPDD | (SEQ ID NO: 760) |
| LSTAADLWAVVTDTVASGLDKDYLKPDD | (SEQ ID NO: 761) |
| *LSTAADLWAVVTDTVASGLDKDYLKPDD | (SEQ ID NO: 762) |
| LSWAADLWAVVTDTVASGLDKDYLKPDD | (SEQ ID NO: 763) |
| *LSWAADLWAVVTDTVASGLDKDYLKPDD | (SEQ ID NO: 764) |
| LSTAADVWAVVTDTVASGLDKDYLKPDD | (SEQ ID NO: 765) |
| *LSTAADVWAVVTDTVASGLDKDYLKPDD | (SEQ ID NO: 766) |
| LSWAADVWAVVTDTVASGLDKDYLKPDD | (SEQ ID NO: 767) |
| *LSWAADVWAVVTDTVASGLDKDYLKPDD | (SEQ ID NO: 768) |
| LSTAADMQGVVWDTVASGLDKDYLKPDD | (SEQ ID NO: 769) |
| *LSTAADMQGVVWDTVASGLDKDYLKPDD | (SEQ ID NO: 770) |
| LSWAADMQGVVWDTVASGLDKDYLKPDD | (SEQ ID NO: 771) |

TABLE 3-continued

| Modified Curedoxin-Derived Peptides | |
|---|---|
| *LSWAADMQGVVWDTVASGLDKDYLKPDD | (SEQ ID NO: 772) |
| LSTAADLQGVVWDTVASGLDKDYLKPDD | (SEQ ID NO: 773) |
| *LSTAADLQGVVWDTVASGLDKDYLKPDD | (SEQ ID NO: 774) |
| LSWAADLQGVVWDTVASGLDKDYLKPDD | (SEQ ID NO: 775) |
| *LSWAADLQGVVWDTVASGLDKDYLKPDD | (SEQ ID NO: 776) |
| LSTAADVQGVVWDTVASGLDKDYLKPDD | (SEQ ID NO: 777) |
| *LSTAADVQGVVWDTVASGLDKDYLKPDD | (SEQ ID NO: 778) |
| LSWAADVQGVVWDTVASGLDKDYLKPDD | (SEQ ID NO: 779) |
| *LSWAADVQGVVWDTVASGLDKDYLKPDD | (SEQ ID NO: 780) |
| LSTAADMWGVVWDTVASGLDKDYLKPDD | (SEQ ID NO: 781) |
| *LSTAADMWGVVWDTVASGLDKDYLKPDD | (SEQ ID NO: 782) |
| LSWAADMWGVVWDTVASGLDKDYLKPDD | (SEQ ID NO: 783) |
| *LSWAADMWGVVWDTVASGLDKDYLKPDD | (SEQ ID NO: 784) |
| LSTAADLWGVVWDTVASGLDKDYLKPDD | (SEQ ID NO: 785) |
| *LSTAADLWGVVWDTVASGLDKDYLKPDD | (SEQ ID NO: 786) |
| LSWAADLWGVVWDTVASGLDKDYLKPDD | (SEQ ID NO: 787) |
| *LSWAADLWGVVWDTVASGLDKDYLKPDD | (SEQ ID NO: 788) |
| LSTAADVWGVVWDTVASGLDKDYLKPDD | (SEQ ID NO: 789) |
| *LSTAADVWGVVWDTVASGLDKDYLKPDD | (SEQ ID NO: 790) |
| LSWAADVWGVVWDTVASGLDKDYLKPDD | (SEQ ID NO: 791) |
| *LSWAADVWGVVWDTVASGLDKDYLKPDD | (SEQ ID NO: 792) |
| LSTAADMQAVVWDTVASGLDKDYLKPDD | (SEQ ID NO: 793) |
| *LSTAADMQAVVWDTVASGLDKDYLKPDD | (SEQ ID NO: 794) |
| LSWAADMQAVVWDTVASGLDKDYLKPDD | (SEQ ID NO: 795) |
| *LSWAADMQAVVWDTVASGLDKDYLKPDD | (SEQ ID NO: 796) |
| LSTAADLQAVVWDTVASGLDKDYLKPDD | (SEQ ID NO: 797) |
| *LSTAADLQAVVWDTVASGLDKDYLKPDD | (SEQ ID NO: 798) |
| LSWAADLQAVVWDTVASGLDKDYLKPDD | (SEQ ID NO: 799) |
| *LSWAADLQAVVWDTVASGLKDYLKPDD | (SEQ ID NO: 800) |
| LSTAADVQAVVWDTVASGLDKDYLKPDD | (SEQ ID NO: 801) |
| *LSTAADVQAVVWDTVASGLDKDYLKPDD | (SEQ ID NO: 802) |
| LSWAADVQAVVWDTVASGLDKDYLKPDD | (SEQ ID NO: 803) |
| *LSWAADVQAVVWDTVASGLDKDYLKPDD | (SEQ ID NO: 804) |
| LSTAADMWAVVWDTVASGLDKDYLKPDD | (SEQ ID NO: 805) |
| *LSTAADMWAVVWDTVASGLDKDYLKPDD | (SEQ ID NO: 806) |
| LSWAADMWAVVWDTVASGLDKDYLKPDD | (SEQ ID NO: 807) |
| *LSWAADMWAVVWDTVASGLDKDYLKPDD | (SEQ ID NO: 808) |
| LSTAADLWAVVWDTVASGLDKDYLKPDD | (SEQ ID NO: 809) |
| *LSTAADLWAVVWDTVASGLDKDYLKPDD | (SEQ ID NO: 810) |

TABLE 3-continued

| Modified Curedoxin-Derived Peptides | |
|---|---|
| LSWAADLWAVVWDTVASGLDKDYLKPDD | (SEQ ID NO: 811) |
| *LSWAADLWAVVWDTVASGLDKDYLKPDD | (SEQ ID NO: 812) |
| LSTAADVWAVVWDTVASGLDKDYLKPDD | (SEQ ID NO: 813) |
| *LSTAADVWAVVWDTVASGLDKDYLKPDD | (SEQ ID NO: 814) |
| LSWAADVWAVVWDTVASGLDKDYLKPDD | (SEQ ID NO: 815) |
| *LSWAADVWAVVWDTVASGLDKDYLKPDD | (SEQ ID NO: 816) |
| LSTAADMQGVVTDWVASGLDKDYLKPDD | (SEQ ID NO: 817) |
| *LSTAADMQGVVTDWVASGLDKDYLKPDD | (SEQ ID NO: 818) |
| LSWAADMQGVVTDWVASGLDKDYLKPDD | (SEQ ID NO: 819) |
| *LSWAADMQGVVTDWVASGLDKDYLKPDD | (SEQ ID NO: 820) |
| LSTAADLQGVVTDWVASGLDKDYLKPDD | (SEQ ID NO: 821) |
| *LSTAADLQGVVTDWVASGLDKDYLKPDD | (SEQ ID NO: 822) |
| LSWAADLQGVVTDWVASGLDKDYLKPDD | (SEQ ID NO: 823) |
| *LSWAADLQGVVTDWVASGLDKDYLKPDD | (SEQ ID NO: 824) |
| LSTAADVQGVVTDWVASGLDKDYLKPDD | (SEQ ID NO: 825) |
| *LSTAADVQGVVTDWVASGLDKDYLKPDD | (SEQ ID NO: 826) |
| LSWAADVQGVVTDWVASGLDKDYLKPDD | (SEQ ID NO: 827) |
| *LSWAADVQGVVTDWVASGLDKDYLKPDD | (SEQ ID NO: 828) |
| LSTAADMWGVVTDWVASGLDKDYLKPDD | (SEQ ID NO: 829) |
| *LSTAADMWGVVTDWVASGLDKDYLKPDD | (SEQ ID NO: 830) |
| LSWAADMWGVVTDWVASGLDKDYLKPDD | (SEQ ID NO: 831) |
| *LSWAADMWGVVTDWVASGLDKDYLKPDD | (SEQ ID NO: 832) |
| LSTAADLWGVVTDWVASGLDKDYLKPDD | (SEQ ID NO: 833) |
| *LSTAADLWGVVTDWVASGLDKDYLKPDD | (SEQ ID NO: 834) |
| LSWAADLWGVVTDWVASGLDKDYLKPDD | (SEQ ID NO: 835) |
| *LSWAADLWGVVTDWVASGLDKDYLKPDD | (SEQ ID NO: 836) |
| LSTAADVWGVVTDWVASGLDKDYLKPDD | (SEQ ID NO: 837) |
| *LSTAADVWGVVTDWVASGLDKDYLKPDD | (SEQ ID NO: 838) |
| LSWAADVWGVVTDWVASGLDKDYLKPDD | (SEQ ID NO: 839) |
| *LSWAADVWGVVTDWVASGLDKDYLKPDD | (SEQ ID NO: 840) |
| LSTAADMQAVVTDWVASGLDKDYLKPDD | (SEQ ID NO: 841) |
| *LSTAADMQAVVTDWVASGLDKDYLKPDD | (SEQ ID NO: 842) |
| LSWAADMQAVVTDWVASGLDKDYLKPDD | (SEQ ID NO: 843) |
| *LSWAADMQAVVTDWVASGLDKDYLKPDD | (SEQ ID NO: 844) |
| LSTAADLQAVVTDWVASGLDKDYLKPDD | (SEQ ID NO: 845) |
| *LSTAADLQAVVTDWVASGLDKDYLKPDD | (SEQ ID NO: 846) |
| LSWAADLQAVVTDWVASGLDKDYLKPDD | (SEQ ID NO: 847) |
| *LSWAADLQAVVTDWVASGLDKDYLKPDD | (SEQ ID NO: 848) |
| LSTAADVQAVVTDWVASGLDKDYLKPDD | (SEQ ID NO: 849) |

TABLE 3-continued

| Modified Curedoxin-Derived Peptides | |
|---|---|
| *LSTAADVQAVVTDWVASGLDKDYLKPDD | (SEQ ID NO: 850) |
| LSWAADVQAVVTDWVASGLDKDYLKPDD | (SEQ ID NO: 851) |
| *LSWAADVQAVVTDWVASGLDKDYLKPDD | (SEQ ID NO: 852) |
| LSTAADMWAVVTDWVASGLDKDYLKPDD | (SEQ ID NO: 853) |
| *LSTAADMWAVVTDWVASGLDKDYLKPDD | (SEQ ID NO: 854) |
| LSWAADMWAVVTDWVASGLDKDYLKPDD | (SEQ ID NO: 855) |
| *LSWAADMWAVVTDWVASGLDKDYLKPDD | (SEQ ID NO: 856) |
| LSTAADLWAVVTDWVASGLDKDYLKPDD | (SEQ ID NO: 857) |
| *LSTAADLWAVVTDWVASGLDKDYLKPDD | (SEQ ID NO: 858) |
| LSWAADLWAVVTDWVASGLDKDYLKPDD | (SEQ ID NO: 859) |
| *LSWAADLWAVVTDWVASGLDKDYLKPDD | (SEQ ID NO: 860) |
| LSTAADVWAVVTDWVASGLDKDYLKPDD | (SEQ ID NO: 861) |
| *LSTAADVWAVVTDWVASGLDKDYLKPDD | (SEQ ID NO: 862) |
| LSWAADVWAVVTDWVASGLDKDYLKPDD | (SEQ ID NO: 863) |
| *LSWAADVWAVVTDWVASGLDKDYLKPDD | (SEQ ID NO: 864) |
| LSTAADMQGVVWDWVASGLDKDYLKPDD | (SEQ ID NO: 865) |
| *LSTAADMQGVVWDWVASGLDKDYLKPDD | (SEQ ID NO: 866) |
| LSWAADMQGVVWDWVASGLDKDYLKPDD | (SEQ ID NO: 867) |
| *LSWAADMQGVVWDWVASGLDKDYLKPDD | (SEQ ID NO: 868) |
| LSTAADLQGVVWDWVASGLDKDYLKPDD | (SEQ ID NO: 869) |
| *LSTAADLQGVVWDWVASGLDKDYLKPDD | (SEQ ID NO: 870) |
| LSWAADLQGVVWDWVASGLDKDYLKPDD | (SEQ ID NO: 871) |
| *LSWAADLQGVVWDWVASGLDKDYLKPDD | (SEQ ID NO: 872) |
| LSTAADVQGVVWDWVASGLDKDYLKPDD | (SEQ ID NO: 873) |
| *LSTAADVQGVVWDWVASGLDKDYLKPDD | (SEQ ID NO: 874) |
| LSWAADVQGVVWDWVASGLDKDYLKPDD | (SEQ ID NO: 875) |
| *LSWAADVQGVVWDWVASGLDKDYLKPDD | (SEQ ID NO: 876) |
| LSTAADMWGVVWDWVASGLDKDYLKPDD | (SEQ ID NO: 877) |
| *LSTAADMWGVVWDWVASGLDKDYLKPDD | (SEQ ID NO: 878) |
| LSWAADMWGVVWDWVASGLDKDYLKPDD | (SEQ ID NO: 879) |
| *LSWAADMWGVVWDWVASGLDKDYLKPDD | (SEQ ID NO: 880) |
| LSTAADLWGVVWDWVASGLDKDYLKPDD | (SEQ ID NO: 881) |
| *LSTAADLWGVVWDWVASGLDKDYLKPDD | (SEQ ID NO: 882) |
| LSWAADLWGVVWDWVASGLDKDYLKPDD | (SEQ ID NO: 883) |
| *LSWAADLWGVVWDWVASGLDKDYLKPDD | (SEQ ID NO: 884) |
| LSTAADVWGVVWDWVASGLDKDYLKPDD | (SEQ ID NO: 885) |
| *LSTAADVWGVVWDWVASGLDKDYLKPDD | (SEQ ID NO: 886) |
| LSWAADVWGVVWDWVASGLDKDYLKPDD | (SEQ ID NO: 887) |
| *LSWAADVWGVVWDWVASGLDKDYLKPDD | (SEQ ID NO: 888) |

TABLE 3-continued

| Modified Curedoxin-Derived Peptides | |
|---|---|
| LSTAADMQAVVWDWVASGLDKDYLKPDD | (SEQ ID NO: 889) |
| *LSTAADMQAVVWDWVASGLDKDYLKPDD | (SEQ ID NO: 890) |
| LSWAADMQAVVWDWVASGLDKDYLKPDD | (SEQ ID NO: 891) |
| *LSWAADMQAVVWDWVASGLDKDYLKPDD | (SEQ ID NO: 892) |
| LSTAADLQAVVWDWVASGLDKDYLKPDD | (SEQ ID NO: 893) |
| *LSTAADLQAVVWDWVASGLDKDYLKPDD | (SEQ ID NO: 894) |
| LSWAADLQAVVWDWVASGLDKDYLKPDD | (SEQ ID NO: 895) |
| *LSWAADLQAVVWDWVASGLDKDYLKPDD | (SEQ ID NO: 896) |
| LSTAADVQAVVWDWVASGLDKDYLKPDD | (SEQ ID NO: 897) |
| *LSTAADVQAVVWDWVASGLDKDYLKPDD | (SEQ ID NO: 898) |
| LSWAADVQAVVWDWVASGLDKDYLKPDD | (SEQ ID NO: 899) |
| *LSWAADVQAVVWDWVASGLDKDYLKPDD | (SEQ ID NO: 900) |
| LSTAADMWAVVWDWVASGLDKDYLKPDD | (SEQ ID NO: 901) |
| *LSTAADMWAVVWDWVASGLDKDYLKPDD | (SEQ ID NO: 902) |
| LSWAADMWAVVWDWVASGLDKDYLKPDD | (SEQ ID NO: 903) |
| *LSWAADMWAVVWDWVASGLDKDYLKPDD | (SEQ ID NO: 904) |
| LSTAADLWAVVWDWVASGLDKDYLKPDD | (SEQ ID NO: 905) |
| *LSTAADLWAVVWDWVASGLDKDYLKPDD | (SEQ ID NO: 906) |
| LSWAADLWAVVWDWVASGLDKDYLKPDD | (SEQ ID NO: 907) |
| *LSWAADLWAVVWDWVASGLDKDYLKPDD | (SEQ ID NO: 908) |
| LSTAADVWAVVWDWVASGLDKDYLKPDD | (SEQ ID NO: 909) |
| *LSTAADVWAVVWDWVASGLDKDYLKPDD | (SEQ ID NO: 910) |
| LSWAADVWAVVWDWVASGLDKDYLKPDD | (SEQ ID NO: 911) |
| *LSWAADVWAVVWDWVASGLDKDYLKPDD | (SEQ ID NO: 912) |
| LSTAADMQGVVTDGMASGLDKDYLKPDD$ | (SEQ ID NO: 913) |
| *LSTAADMQGVVTDGMASGLDKDYLKPDD$ | (SEQ ID NO: 914) |
| LSWAADMQGVVTDGMASGLDKDYLKPDD$ | (SEQ ID NO: 915) |
| *LSWAADMQGVVTDGMASGLDKDYLKPDD$ | (SEQ ID NO: 916) |
| LSTAADLQGVVTDGMASGLDKDYLKPDD$ | (SEQ ID NO: 917) |
| *LSTAADLQGVVTDGMASGLDKDYLKPDD$ | (SEQ ID NO: 918) |
| LSWAADLQGVVTDGMASGLDKDYLKPDD$ | (SEQ ID NO: 919) |
| *LSWAADLQGVVTDGMASGLDKDYLKPDD$ | (SEQ ID NO: 920) |
| LSTAADVQGVVTDGMASGLDKDYLKPDD$ | (SEQ ID NO: 921) |
| *LSTAADVQGVVTDGMASGLDKDYLKPDD$ | (SEQ ID NO: 922) |
| LSWAADVQGVVTDGMASGLDKDYLKPDD$ | (SEQ ID NO: 923) |
| *LSWAADVQGVVTDGMASGLDKDYLKPDD$ | (SEQ ID NO: 924) |
| LSTAADMWGVVTDGMASGLDKDYLKPDD$ | (SEQ ID NO: 925) |
| *LSTAADMWGVVTDGMASGLDKDYLKPDD$ | (SEQ ID NO: 926) |
| LSWAADMWGVVTDGMASGLDKDYLKPDD$ | (SEQ ID NO: 927) |

TABLE 3-continued

| Modified Curedoxin-Derived Peptides | |
|---|---|
| *LSWAADMWGVVTDGMASGLDKDYLKPDD$ | (SEQ ID NO: 928) |
| LSTAADLWGVVTDGMASGLDKDYLKPDD$ | (SEQ ID NO: 929) |
| *LSTAADLWGVVTDGMASGLDKDYLKPDD$ | (SEQ ID NO: 930) |
| LSWAADLWGVVTDGMASGLDKDYLKPDD$ | (SEQ ID NO: 931) |
| *LSWAADLWGVVTDGMASGLDKDYLKPDD$ | (SEQ ID NO: 932) |
| LSTAADVWGVVTDGMASGLDKDYLKPDD$ | (SEQ ID NO: 933) |
| *LSTAADVWGVVTDGMASGLDKDYLKPDD$ | (SEQ ID NO: 934) |
| LSWAADVWGVVTDGMASGLDKDYLKPDD$ | (SEQ ID NO: 935) |
| *LSWAADVWGVVTDGMASGLDKDYLKPDD$ | (SEQ ID NO: 936) |
| LSTAADMQAVVTDGMASGLDKDYLKPDD$ | (SEQ ID NO: 937) |
| *LSTAADMQAVVTDGMASGLDKDYLKPDD$ | (SEQ ID NO: 938) |
| LSWAADMQAVVTDGMASGLDKDYLKPDD$ | (SEQ ID NO: 939) |
| *LSWAADMQAVVTDGMASGLDKDYLKPDD$ | (SEQ ID NO: 940) |
| LSTAADLQAVVTDGMASGLDKDYLKPDD$ | (SEQ ID NO: 941) |
| *LSTAADLQAVVTDGMASGLDKDYLKPDD$ | (SEQ ID NO: 942) |
| LSWAADLQAVVTDGMASGLDKDYLKPDD$ | (SEQ ID NO: 943) |
| *LSWAADLQAVVTDGMASGLDKDYLKPDD$ | (SEQ ID NO: 944) |
| LSTAADVQAVVTDGMASGLDKDYLKPDD$ | (SEQ ID NO: 945) |
| *LSTAADVQAVVTDGMASGLDKDYLKPDD$ | (SEQ ID NO: 946) |
| LSWAADVQAVVTDGMASGLDKDYLKPDD$ | (SEQ ID NO: 947) |
| *LSWAADVQAVVTDGMASGLDKDYLKPDD$ | (SEQ ID NO: 948) |
| LSTAADMWAVVTDGMASGLDKDYLKPDD$ | (SEQ ID NO: 949) |
| *LSTAADMWAVVTDGMASGLDKDYLKPDD$ | (SEQ ID NO: 950) |
| LSWAADMWAVVTDGMASGLDKDYLKPDD$ | (SEQ ID NO: 951) |
| *LSWAADMWAVVTDGMASGLDKDYLKPDD$ | (SEQ ID NO: 952) |
| LSTAADLWAVVTDGMASGLDKDYLKPDD$ | (SEQ ID NO: 953) |
| *LSTAADLWAVVTDGMASGLDKDYLKPDD$ | (SEQ ID NO: 954) |
| LSWAADLWAVVTDGMASGLDKDYLKPDD$ | (SEQ ID NO: 955) |
| *LSWAADLWAVVTDGMASGLDKDYLKPDD$ | (SEQ ID NO: 956) |
| LSTAADVWAVVTDGMASGLDKDYLKPDD$ | (SEQ ID NO: 957) |
| *LSTAADVWAVVTDGMASGLDKDYLKPDD$ | (SEQ ID NO: 958) |
| LSWAADVWAVVTDGMASGLDKDYLKPDD$ | (SEQ ID NO: 959) |
| *LSWAADVWAVVTDGMASGLDKDYLKPDD$ | (SEQ ID NO: 960) |
| LSTAADMQGVVWDGMASGLDKDYLKPDD$ | (SEQ ID NO: 961) |
| *LSTAADMQGVVWDGMASGLDKDYLKPDD$ | (SEQ ID NO: 962) |
| LSWAADMQGVVWDGMASGLDKDYLKPDD$ | (SEQ ID NO: 963) |
| *LSWAADMQGVVWDGMASGLDKDYLKPDD$ | (SEQ ID NO: 964) |
| LSTAADLQGVVWDGMASGLDKDYLKPDD$ | (SEQ ID NO: 965) |
| *LSTAADLQGVVWDGMASGLDKDYLKPDD$ | (SEQ ID NO: 966) |

TABLE 3-continued

| Modified Curedoxin-Derived Peptides | |
|---|---|
| LSWAADLQGVVWDGMASGLDKDYLKPDD$ | (SEQ ID NO: 967) |
| *LSWAADLQGVVWDGMASGLDKDYLKPDD$ | (SEQ ID NO: 968) |
| LSTAADVQGVVWDGMASGLDKDYLKPDD$ | (SEQ ID NO: 969) |
| *LSTAADVQGVVWDGMASGLDKDYLKPDD$ | (SEQ ID NO: 970) |
| LSWAADVQGVVWDGMASGLDKDYLKPDD$ | (SEQ ID NO: 971) |
| *LSWAADVQGVVWDGMASGLDKDYLKPDD$ | (SEQ ID NO: 972) |
| LSTAADMWGVVWDGMASGLDKDYLKPDD$ | (SEQ ID NO: 973) |
| *LSTAADMWGVVWDGMASGLDKDYLKPDD$ | (SEQ ID NO: 974) |
| LSWAADMWGVVWDGMASGLDKDYLKPDD$ | (SEQ ID NO: 975) |
| *LSWAADMWGVVWDGMASGLDKDYLKPDD$ | (SEQ ID NO: 976) |
| LSTAADLWGVVWDGMASGLDKDYLKPDD$ | (SEQ ID NO: 977) |
| *LSTAADLWGVVWDGMASGLDKDYLKPDD$ | (SEQ ID NO: 978) |
| LSWAADLWGVVWDGMASGLDKDYLKPDD$ | (SEQ ID NO: 979) |
| *LSWAADLWGVVWDGMASGLDKDYLKPDD$ | (SEQ ID NO: 980) |
| LSTAADVWGVVWDGMASGLDKDYLKPDD$ | (SEQ ID NO: 981) |
| *LSTAADVWGVVWDGMASGLDKDYLKPDD$ | (SEQ ID NO: 982) |
| LSWAADVWGVVWDGMASGLDKDYLKPDD$ | (SEQ ID NO: 983) |
| *LSWAADVWGVVWDGMASGLDKDYLKPDD$ | (SEQ ID NO: 984) |
| LSTAADMQAVVWDGMASGLDKDYLKPDD$ | (SEQ ID NO: 985) |
| *LSTAADMQAVVWDGMASGLDKDYLKPDD$ | (SEQ ID NO: 986) |
| LSWAADMQAVVWDGMASGLDKDYLKPDD$ | (SEQ ID NO: 987) |
| *LSWAADMQAVVWDGMASGLDKDYLKPDD$ | (SEQ ID NO: 988) |
| LSTAADLQAVVWDGMASGLDKDYLKPDD$ | (SEQ ID NO: 989) |
| *LSTAADLQAVVWDGMASGLDKDYLKPDD$ | (SEQ ID NO: 990) |
| LSWAADLQAVVWDGMASGLDKDYLKPDD$ | (SEQ ID NO: 991) |
| *LSWAADLQAVVWDGMASGLDKDYLKPDD$ | (SEQ ID NO: 992) |
| LSTAADVQAVVWDGMASGLDKDYLKPDD$ | (SEQ ID NO: 993) |
| *LSTAADVQAVVWDGMASGLDKDYLKPDD$ | (SEQ ID NO: 994) |
| LSWAADVQAVVWDGMASGLDKDYLKPDD$ | (SEQ ID NO: 995) |
| *LSWAADVQAVVWDGMASGLDKDYLKPDD$ | (SEQ ID NO: 996) |
| LSTAADMWAVVWDGMASGLDKDYLKPDD$ | (SEQ ID NO: 997) |
| *LSTAADMWAVVWDGMASGLDKDYLKPDD$ | (SEQ ID NO: 998) |
| LSWAADMWAVVWDGMASGLDKDYLKPDD$ | (SEQ ID NO: 999) |
| *LSWAADMWAVVWDGMASGLDKDYLKPDD$ | (SEQ ID NO: 1000) |
| LSTAADLWAVVWDGMASGLDKDYLKPDD$ | (SEQ ID NO: 1001) |
| *LSTAADLWAVVWDGMASGLDKDYLKPDD$ | (SEQ ID NO: 1002) |
| LSWAADLWAVVWDGMASGLDKDYLKPDD$ | (SEQ ID NO: 1003) |
| *LSWAADLWAVVWDGMASGLDKDYLKPDD$ | (SEQ ID NO: 1004) |
| LSTAADVWAVVWDGMASGLDKDYLKPDD$ | (SEQ ID NO: 1005) |

TABLE 3-continued

| Modified Curedoxin-Derived Peptides | |
|---|---|
| *LSTAADVWAVVWDGMASGLDKDYLKPDD$ | (SEQ ID NO: 1006) |
| LSWAADVWAVVWDGMASGLDKDYLKPDD$ | (SEQ ID NO: 1007) |
| *LSWAADVWAVVWDGMASGLDKDYLKPDD$ | (SEQ ID NO: 1008) |
| LSTAADMQGVVTDTMASGLDKDYLKPDD$ | (SEQ ID NO: 1009) |
| *LSTAADMQGVVTDTMASGLDKDYLKPDD$ | (SEQ ID NO: 1010) |
| LSWAADMQGVVTDTMASGLDKDYLKPDD$ | (SEQ ID NO: 1011) |
| *LSWAADMQGVVTDTMASGLDKDYLKPDD$ | (SEQ ID NO: 1012) |
| LSTAADLQGVVTDTMASGLDKDYLKPDD$ | (SEQ ID NO: 1013) |
| *LSTAADLQGVVTDTMASGLDKDYLKPDD$ | (SEQ ID NO: 1014) |
| LSWAADLQGVVTDTMASGLDKDYLKPDD$ | (SEQ ID NO: 1015) |
| *LSWAADLQGVVTDTMASGLDKDYLKPDD$ | (SEQ ID NO: 1016) |
| LSTAADVQGVVTDTMASGLDKDYLKPDD$ | (SEQ ID NO: 1017) |
| *LSTAADVQGVVTDTMASGLDKDYLKPDD$ | (SEQ ID NO: 1018) |
| LSWAADVQGVVTDTMASGLDKDYLKPDD$ | (SEQ ID NO: 1019) |
| *LSWAADVQGVVTDTMASGLDKDYLKPDD$ | (SEQ ID NO: 1020) |
| LSTAADMWGVVTDTMASGLDKDYLKPDD$ | (SEQ ID NO: 1021) |
| *LSTAADMWGVVTDTMASGLDKDYLKPDD$ | (SEQ ID NO: 1022) |
| LSWAADMWGVVTDTMASGLDKDYLKPDD$ | (SEQ ID NO: 1023) |
| *LSWAADMWGVVTDTMASGLDKDYLKPDD$ | (SEQ ID NO: 1024) |
| LSTAADLWGVVTDTMASGLDKDYLKPDD$ | (SEQ ID NO: 1025) |
| *LSTAADLWGVVTDTMASGLDKDYLKPDD$ | (SEQ ID NO: 1026) |
| LSWAADLWGVVTDTMASGLDKDYLKPDD$ | (SEQ ID NO: 1027) |
| *LSWAADLWGVVTDTMASGLDKDYLKPDD$ | (SEQ ID NO: 1028) |
| LSTAADVWGVVTDTMASGLDKDYLKPDD$ | (SEQ ID NO: 1029) |
| *LSTAADVWGVVTDTMASGLDKDYLKPDD$ | (SEQ ID NO: 1030) |
| LSWAADVWGVVTDTMASGLDKDYLKPDD$ | (SEQ ID NO: 1031) |
| *LSWAADVWGVVTDTMASGLDKDYLKPDD$ | (SEQ ID NO: 1032) |
| LSTAADMQAVVTDTMASGLDKDYLKPDD$ | (SEQ ID NO: 1033) |
| *LSTAADMQAVVTDTMASGLDKDYLKPDD$ | (SEQ ID NO: 1034) |
| LSWAADMQAVVTDTMASGLDKDYLKPDD$ | (SEQ ID NO: 1035) |
| *LSWAADMQAVVTDTMASGLDKDYLKPDD$ | (SEQ ID NO: 1036) |
| LSTAADLQAVVTDTMASGLDKDYLKPDD$ | (SEQ ID NO: 1037) |
| *LSTAADLQAVVTDTMASGLDKDYLKPDD$ | (SEQ ID NO: 1038) |
| LSWAADLQAVVTDTMASGLDKDYLKPDD$ | (SEQ ID NO: 1039) |
| *LSWAADLQAVVTDTMASGLDKDYLKPDD$ | (SEQ ID NO: 1040) |
| LSTAADVQAVVTDTMASGLDKDYLKPDD$ | (SEQ ID NO: 1041) |
| *LSTAADVQAVVTDTMASGLDKDYLKPDD$ | (SEQ ID NO: 1042) |
| LSWAADVQAVVTDTMASGLDKDYLKPDD$ | (SEQ ID NO: 1043) |
| *LSWAADVQAVVTDTMASGLDKDYLKPDD$ | (SEQ ID NO: 1044) |

TABLE 3-continued

| Modified Curedoxin-Derived Peptides | |
|---|---|
| LSTAADMWAVVTDTMASGLDKDYLKPDD$ | (SEQ ID NO: 1045) |
| *LSTAADMWAVVTDTMASGLDKDYLKPDD$ | (SEQ ID NO: 1046) |
| LSWAADMWAVVTDTMASGLDKDYLKPDD$ | (SEQ ID NO: 1047) |
| *LSWAADMWAVVTDTMASGLDKDYLKPDD$ | (SEQ ID NO: 1048) |
| LSTAADLWAVVTDTMASGLDKDYLKPDD$ | (SEQ ID NO: 1049) |
| *LSTAADLWAVVTDTMASGLDKDYLKPDD$ | (SEQ ID NO: 1050) |
| LSWAADLWAVVTDTMASGLDKDYLKPDD$ | (SEQ ID NO: 1051) |
| *LSWAADLWAVVTDTMASGLDKDYLKPDD$ | (SEQ ID NO: 1052) |
| LSTAADVWAVVTDTMASGLDKDYLKPDD$ | (SEQ ID NO: 1053) |
| *LSTAADVWAVVTDTMASGLDKDYLKPDD$ | (SEQ ID NO: 1054) |
| LSWAADVWAVVTDTMASGLDKDYLKPDD$ | (SEQ ID NO: 1055) |
| *LSWAADVWAVVTDTMASGLDKDYLKPDD$ | (SEQ ID NO: 1056) |
| LSTAADMQGVVWDTMASGLDKDYLKPDD$ | (SEQ ID NO: 1057) |
| *LSTAADMQGVVWDTMASGLDKDYLKPDD$ | (SEQ ID NO: 1058) |
| LSWAADMQGVVWDTMASGLDKDYLKPDD$ | (SEQ ID NO: 1059) |
| *LSWAADMQGVVWDTMASGLDKDYLKPDD$ | (SEQ ID NO: 1060) |
| LSTAADLQGVVWDTMASGLDKDYLKPDD$ | (SEQ ID NO: 1061) |
| *LSTAADLQGVVWDTMASGLDKDYLKPDD$ | (SEQ ID NO: 1062) |
| LSWAADLQGVVWDTMASGLDKDYLKPDD$ | (SEQ ID NO: 1063) |
| *LSWAADLQGVVWDTMASGLDKDYLKPDD$ | (SEQ ID NO: 1064) |
| LSTAADVQGVVWDTMASGLDKDYLKPDD$ | (SEQ ID NO: 1065) |
| *LSTAADVQGVVWDTMASGLDKDYLKPDD$ | (SEQ ID NO: 1066) |
| LSWAADVQGVVWDTMASGLDKDYLKPDD$ | (SEQ ID NO: 1067) |
| *LSWAADVQGVVWDTMASGLDKDYLKPDD$ | (SEQ ID NO: 1068) |
| LSTAADMWGVVWDTMASGLDKDYLKPDD$ | (SEQ ID NO: 1069) |
| *LSTAADMWGVVWDTMASGLDKDYLKPDD$ | (SEQ ID NO: 1070) |
| LSWAADMWGVVWDTMASGLDKDYLKPDD$ | (SEQ ID NO: 1071) |
| *LSWAADMWGVVWDTMASGLDKDYLKPDD$ | (SEQ ID NO: 1072) |
| LSTAADLWGVVWDTMASGLDKDYLKPDD$ | (SEQ ID NO: 1073) |
| *LSTAADLWGVVWDTMASGLDKDYLKPDD$ | (SEQ ID NO: 1074) |
| LSWAADLWGVVWDTMASGLDKDYLKPDD$ | (SEQ ID NO: 1075) |
| *LSWAADLWGVVWDTMASGLDKDYLKPDD$ | (SEQ ID NO: 1076) |
| LSTAADVWGVVWDTMASGLDKDYLKPDD$ | (SEQ ID NO: 1077) |
| *LSTAADVWGVVWDTMASGLDKDYLKPDD$ | (SEQ ID NO: 1078) |
| LSWAADVWGVVWDTMASGLDKDYLKPDD$ | (SEQ ID NO: 1079) |
| *LSWAADVWGVVWDTMASGLDKDYLKPDD$ | (SEQ ID NO: 1080) |
| LSTAADMQAVVWDTMASGLDKDYLKPDD$ | (SEQ ID NO: 1081) |
| *LSTAADMQAVVWDTMASGLDKDYLKPDD$ | (SEQ ID NO: 1082) |
| LSWAADMQAVVWDTMASGLDKDYLKPDD$ | (SEQ ID NO: 1083) |

TABLE 3-continued

| Modified Curedoxin-Derived Peptides | |
|---|---|
| *LSWAADMQAVVWDTMASGLDKDYLKPDD$ | (SEQ ID NO: 1084) |
| LSTAADLQAVVWDTMASGLDKDYLKPDD$ | (SEQ ID NO: 1085) |
| *LSTAADLQAVVWDTMASGLDKDYLKPDD$ | (SEQ ID NO: 1086) |
| LSWAADLQAVVWDTMASGLDKDYLKPDD$ | (SEQ ID NO: 1087) |
| *LSWAADLQAVVWDTMASGLDKDYLKPDD$ | (SEQ ID NO: 1088) |
| LSTAADVQAVVWDTMASGLDKDYLKPDD$ | (SEQ ID NO: 1089) |
| *LSTAADVQAVVWDTMASGLDKDYLKPDD$ | (SEQ ID NO: 1090) |
| LSWAADVQAVVWDTMASGLDKDYLKPDD$ | (SEQ ID NO: 1091) |
| *LSWAADVQAVVWDTMASGLDKDYLKPDD$ | (SEQ ID NO: 1092) |
| LSTAADMWAVVWDTMASGLDKDYLKPDD$ | (SEQ ID NO: 1093) |
| *LSTAADMWAVVWDTMASGLDKDYLKPDD$ | (SEQ ID NO: 1094) |
| LSWAADMWAVVWDTMASGLDKDYLKPDD$ | (SEQ ID NO: 1095) |
| *LSWAADMWAVVWDTMASGLDKDYLKPDD$ | (SEQ ID NO: 1096) |
| LSTAADLWAVVWDTMASGLDKDYLKPDD$ | (SEQ ID NO: 1097) |
| *LSTAADLWAVVWDTMASGLDKDYLKPDD$ | (SEQ ID NO: 1098) |
| LSWAADLWAVVWDTMASGLDKDYLKPDD$ | (SEQ ID NO: 1099) |
| *LSWAADLWAVVWDTMASGLDKDYLKPDD$ | (SEQ ID NO: 1100) |
| LSTAADVWAVVWDTMASGLDKDYLKPDD$ | (SEQ ID NO: 1101) |
| *LSTAADVWAVVWDTMASGLDKDYLKPDD$ | (SEQ ID NO: 1102) |
| LSWAADVWAVVWDTMASGLDKDYLKPDD$ | (SEQ ID NO: 1103) |
| *LSWAADVWAVVWDTMASGLDKDYLKPDD$ | (SEQ ID NO: 1104) |
| LSTAADMQGVVTDWMASGLDKDYLKPDD$ | (SEQ ID NO: 1105) |
| *LSTAADMQGVVTDWMASGLDKDYLKPDD$ | (SEQ ID NO: 1106) |
| LSWAADMQGVVTDWMASGLDKDYLKPDD$ | (SEQ ID NO: 1107) |
| *LSWAADMQGVVTDWMASGLDKDYLKPDD$ | (SEQ ID NO: 1108) |
| LSTAADLQGVVTDWMASGLDKDYLKPDD$ | (SEQ ID NO: 1109) |
| *LSTAADLQGVVTDWMASGLDKDYLKPDD$ | (SEQ ID NO: 1110) |
| LSWAADLQGVVTDWMASGLDKDYLKPDD$ | (SEQ ID NO: 1111) |
| *LSWAADLQGVVTDWMASGLDKDYLKPDD$ | (SEQ ID NO: 1112) |
| LSTAADVQGVVTDWMASGLDKDYLKPDD$ | (SEQ ID NO: 1113) |
| *LSTAADVQGVVTDWMASGLDKDYLKPDD$ | (SEQ ID NO: 1114) |
| LSWAADVQGVVTDWMASGLDKDYLKPDD$ | (SEQ ID NO: 1115) |
| *LSWAADVQGVVTDWMASGLDKDYLKPDD$ | (SEQ ID NO: 1116) |
| LSTAADMWGVVTDWMASGLDKDYLKPDD$ | (SEQ ID NO: 1117) |
| *LSTAADMWGVVTDWMASGLDKDYLKPDD$ | (SEQ ID NO: 1118) |
| LSWAADMWGVVTDWMASGLDKDYLKPDD$ | (SEQ ID NO: 1119) |
| *LSWAADMWGVVTDWMASGLDKDYLKPDD$ | (SEQ ID NO: 1120) |
| LSTAADLWGVVTDWMASGLDKDYLKPDD$ | (SEQ ID NO: 1121) |
| *LSTAADLWGVVTDWMASGLDKDYLKPDD$ | (SEQ ID NO: 1122) |

TABLE 3-continued

| Modified Curedoxin-Derived Peptides | |
|---|---|
| LSWAADLWGVVTDWMASGLDKDYLKPDD$ | (SEQ ID NO: 1123) |
| *LSWAADLWGVVTDWMASGLDKDYLKPDD$ | (SEQ ID NO: 1124) |
| LSTAADVWGVVTDWMASGLDKDYLKPDD$ | (SEQ ID NO: 1125) |
| *LSTAADVWGVVTDWMASGLDKDYLKPDD$ | (SEQ ID NO: 1126) |
| LSWAADVWGVVTDWMASGLDKDYLKPDD$ | (SEQ ID NO: 1127) |
| *LSWAADVWGVVTDWMASGLDKDYLKPDD$ | (SEQ ID NO: 1128) |
| LSTAADMQAVVTDWMASGLDKDYLKPDD$ | (SEQ ID NO: 1129) |
| *LSTAADMQAVVTDWMASGLDKDYLKPDD$ | (SEQ ID NO: 1130) |
| LSWAADMQAVVTDWMASGLDKDYLKPDD$ | (SEQ ID NO: 1131) |
| *LSWAADMQAVVTDWMASGLDKDYLKPDD$ | (SEQ ID NO: 1132) |
| LSTAADLQAVVTDWMASGLDKDYLKPDD$ | (SEQ ID NO: 1133) |
| *LSTAADLQAVVTDWMASGLDKDYLKPDD$ | (SEQ ID NO: 1134) |
| LSWAADLQAVVTDWMASGLDKDYLKPDD$ | (SEQ ID NO: 1135) |
| *LSWAADLQAVVTDWMASGLDKDYLKPDD$ | (SEQ ID NO: 1136) |
| LSTAADVQAVVTDWMASGLDKDYLKPDD$ | (SEQ ID NO: 1137) |
| *LSTAADVQAVVTDWMASGLDKDYLKPDD$ | (SEQ ID NO: 1138) |
| LSWAADVQAVVTDWMASGLDKDYLKPDD$ | (SEQ ID NO: 1139) |
| *LSWAADVQAVVTDWMASGLDKDYLKPDD$ | (SEQ ID NO: 1140) |
| LSTAADMWAVVTDWMASGLDKDYLKPDD$ | (SEQ ID NO: 1141) |
| *LSTAADMWAVVTDWMASGLDKDYLKPDD$ | (SEQ ID NO: 1142) |
| LSWAADMWAVVTDWMASGLDKDYLKPDD$ | (SEQ ID NO: 1143) |
| *LSWAADMWAVVTDWMASGLDKDYLKPDD$ | (SEQ ID NO: 1144) |
| LSTAADLWAVVTDWMASGLDKDYLKPDD$ | (SEQ ID NO: 1145) |
| *LSTAADLWAVVTDWMASGLDKDYLKPDD$ | (SEQ ID NO: 1146) |
| LSWAADLWAVVTDWMASGLDKDYLKPDD$ | (SEQ ID NO: 1147) |
| *LSWAADLWAVVTDWMASGLDKDYLKPDD$ | (SEQ ID NO: 1148) |
| LSTAADVWAVVTDWMASGLDKDYLKPDD$ | (SEQ ID NO: 1149) |
| *LSTAADVWAVVTDWMASGLDKDYLKPDD$ | (SEQ ID NO: 1150) |
| LSWAADVWAVVTDWMASGLDKDYLKPDD$ | (SEQ ID NO: 1151) |
| *LSWAADVWAVVTDWMASGLDKDYLKPDD$ | (SEQ ID NO: 1152) |
| LSTAADMQGVVWDWMASGLDKDYLKPDD$ | (SEQ ID NO: 1153) |
| *LSTAADMQGVVWDWMASGLDKDYLKPDD$ | (SEQ ID NO: 1154) |
| LSWAADMQGVVWDWMASGLDKDYLKPDD$ | (SEQ ID NO: 1155) |
| *LSWAADMQGVVWDWMASGLDKDYLKPDD$ | (SEQ ID NO: 1156) |
| LSTAADLQGVVWDWMASGLDKDYLKPDD$ | (SEQ ID NO: 1157) |
| *LSTAADLQGVVWDWMASGLDKDYLKPDD$ | (SEQ ID NO: 1158) |
| LSWAADLQGVVWDWMASGLDKDYLKPDD$ | (SEQ ID NO: 1159) |
| *LSWAADLQGVVWDWMASGLDKDYLKPDD$ | (SEQ ID NO: 1160) |
| LSTAADVQGVVWDWMASGLDKDYLKPDD$ | (SEQ ID NO: 1161) |

TABLE 3-continued

| Modified Curedoxin-Derived Peptides | |
|---|---|
| *LSTAADVQGVVWDWMASGLDKDYLKPDD$ | (SEQ ID NO: 1162) |
| LSWAADVQGVVWDWMASGLDKDYLKPDD$ | (SEQ ID NO: 1163) |
| *LSWAADVQGVVWDWMASGLDKDYLKPDD$ | (SEQ ID NO: 1164) |
| LSTAADMWGVVWDWMASGLDKDYLKPDD$ | (SEQ ID NO: 1165) |
| *LSTAADMWGVVWDWMASGLDKDYLKPDD$ | (SEQ ID NO: 1166) |
| LSWAADMWGVVWDWMASGLDKDYLKPDD$ | (SEQ ID NO: 1167) |
| *LSWAADMWGVVWDWMASGLDKDYLKPDD$ | (SEQ ID NO: 1168) |
| LSTAADLWGVVWDWMASGLDKDYLKPDD$ | (SEQ ID NO: 1169) |
| *LSTAADLWGVVWDWMASGLDKDYLKPDD$ | (SEQ ID NO: 1170) |
| LSWAADLWGVVWDWMASGLDKDYLKPDD$ | (SEQ ID NO: 1171) |
| *LSWAADLWGVVWDWMASGLDKDYLKPDD$ | (SEQ ID NO: 1172) |
| LSTAADVWGVVWDWMASGLDKDYLKPDD$ | (SEQ ID NO: 1173) |
| *LSTAADVWGVVWDWMASGLDKDYLKPDD$ | (SEQ ID NO: 1174) |
| LSWAADVWGVVWDWMASGLDKDYLKPDD$ | (SEQ ID NO: 1175) |
| *LSWAADVWGVVWDWMASGLDKDYLKPDD$ | (SEQ ID NO: 1176) |
| LSTAADMQAVVWDWMASGLDKDYLKPDD$ | (SEQ ID NO: 1177) |
| *LSTAADMQAVVWDWMASGLDKDYLKPDD$ | (SEQ ID NO: 1178) |
| LSWAADMQAVVWDWMASGLDKDYLKPDD$ | (SEQ ID NO: 1179) |
| *LSWAADMQAVVWDWMASGLDKDYLKPDD$ | (SEQ ID NO: 1180) |
| LSTAADLQAVVWDWMASGLDKDYLKPDD$ | (SEQ ID NO: 1181) |
| *LSTAADLQAVVWDWMASGLDKDYLKPDD$ | (SEQ ID NO: 1182) |
| LSWAADLQAVVWDWMASGLDKDYLKPDD$ | (SEQ ID NO: 1183) |
| *LSWAADLQAVVWDWMASGLDKDYLKPDD$ | (SEQ ID NO: 1184) |
| LSTAADVQAVVWDWMASGLDKDYLKPDD$ | (SEQ ID NO: 1185) |
| *LSTAADVQAVVWDWMASGLDKDYLKPDD$ | (SEQ ID NO: 1186) |
| LSWAADVQAVVWDWMASGLDKDYLKPDD$ | (SEQ ID NO: 1187) |
| *LSWAADVQAVVWDWMASGLDKDYLKPDD$ | (SEQ ID NO: 1188) |
| LSTAADMWAVVWDWMASGLDKDYLKPDD$ | (SEQ ID NO: 1189) |
| *LSTAADMWAVVWDWMASGLDKDYLKPDD$ | (SEQ ID NO: 1190) |
| LSWAADMWAVVWDWMASGLDKDYLKPDD$ | (SEQ ID NO: 1191) |
| *LSWAADMWAVVWDWMASGLDKDYLKPDD$ | (SEQ ID NO: 1192) |
| LSTAADLWAVVWDWMASGLDKDYLKPDD$ | (SEQ ID NO: 1193) |
| *LSTAADLWAVVWDWMASGLDKDYLKPDD$ | (SEQ ID NO: 1194) |
| LSWAADLWAVVWDWMASGLDKDYLKPDD$ | (SEQ ID NO: 1195) |
| *LSWAADLWAVVWDWMASGLDKDYLKPDD$ | (SEQ ID NO: 1196) |
| LSTAADVWAVVWDWMASGLDKDYLKPDD$ | (SEQ ID NO: 1197) |
| *LSTAADVWAVVWDWMASGLDKDYLKPDD$ | (SEQ ID NO: 1198) |
| LSWAADVWAVVWDWMASGLDKDYLKPDD$ | (SEQ ID NO: 1199) |
| *LSWAADVWAVVWDWMASGLDKDYLKPDD$ | (SEQ ID NO: 1200) |

TABLE 3-continued

| Modified Curedoxin-Derived Peptides | |
|---|---|
| LSTAADMQGVVTDGLASGLDKDYLKPDD$ | (SEQ ID NO: 1201) |
| *LSTAADMQGVVTDGLASGLDKDYLKPDD$ | (SEQ ID NO: 1202) |
| LSWAADMQGVVTDGLASGLDKDYLKPDD$ | (SEQ ID NO: 1203) |
| *LSWAADMQGVVTDGLASGLDKDYLKPDD$ | (SEQ ID NO: 1204) |
| LSTAADLQGVVTDGLASGLDKDYLKPDD$ | (SEQ ID NO: 1205) |
| *LSTAADLQGVVTDGLASGLDKDYLKPDD$ | (SEQ ID NO: 1206) |
| LSWAADLQGVVTDGLASGLDKDYLKPDD$ | (SEQ ID NO: 1207) |
| *LSWAADLQGVVTDGLASGLDKDYLKPDD$ | (SEQ ID NO: 1208) |
| LSTAADVQGVVTDGLASGLDKDYLKPDD$ | (SEQ ID NO: 1209) |
| *LSTAADVQGVVTDGLASGLDKDYLKPDD$ | (SEQ ID NO: 1210) |
| LSWAADVQGVVTDGLASGLDKDYLKPDD$ | (SEQ ID NO: 1211) |
| *LSWAADVQGVVTDGLASGLDKDYLKPDD$ | (SEQ ID NO: 1212) |
| LSTAADMWGVVTDGLASGLDKDYLKPDD$ | (SEQ ID NO: 1213) |
| *LSTAADMWGVVTDGLASGLDKDYLKPDD$ | (SEQ ID NO: 1214) |
| LSWAADMWGVVTDGLASGLDKDYLKPDD$ | (SEQ ID NO: 1215) |
| *LSWAADMWGVVTDGLASGLDKDYLKPDD$ | (SEQ ID NO: 1216) |
| LSTAADLWGVVTDGLASGLDKDYLKPDD$ | (SEQ ID NO: 1217) |
| *LSTAADLWGVVTDGLASGLDKDYLKPDD$ | (SEQ ID NO: 1218) |
| LSWAADLWGVVTDGLASGLDKDYLKPDD$ | (SEQ ID NO: 1219) |
| *LSWAADLWGVVTDGLASGLDKDYLKPDD$ | (SEQ ID NO: 1220) |
| LSTAADVWGVVTDGLASGLDKDYLKPDD$ | (SEQ ID NO: 1221) |
| *LSTAADVWGVVTDGLASGLDKDYLKPDD$ | (SEQ ID NO: 1222) |
| LSWAADVWGVVTDGLASGLDKDYLKPDD$ | (SEQ ID NO: 1223) |
| *LSWAADVWGVVTDGLASGLDKDYLKPDD$ | (SEQ ID NO: 1224) |
| LSTAADMQAVVTDGLASGLDKDYLKPDD$ | (SEQ ID NO: 1225) |
| *LSTAADMQAVVTDGLASGLDKDYLKPDD$ | (SEQ ID NO: 1226) |
| LSWAADMQAVVTDGLASGLDKDYLKPDD$ | (SEQ ID NO: 1227) |
| *LSWAADMQAVVTDGLASGLDKDYLKPDD$ | (SEQ ID NO: 1228) |
| LSTAADLQAVVTDGLASGLDKDYLKPDD$ | (SEQ ID NO: 1229) |
| *LSTAADLQAVVTDGLASGLDKDYLKPDD$ | (SEQ ID NO: 1230) |
| LSWAADLQAVVTDGLASGLDKDYLKPDD$ | (SEQ ID NO: 1231) |
| *LSWAADLQAVVTDGLASGLDKDYLKPDD$ | (SEQ ID NO: 1232) |
| LSTAADVQAVVTDGLASGLDKDYLKPDD$ | (SEQ ID NO: 1233) |
| *LSTAADVQAVVTDGLASGLDKDYLKPDD$ | (SEQ ID NO: 1234) |
| LSWAADVQAVVTDGLASGLDKDYLKPDD$ | (SEQ ID NO: 1235) |
| *LSWAADVQAVVTDGLASGLDKDYLKPDD$ | (SEQ ID NO: 1236) |
| LSTAADMWAVVTDGLASGLDKDYLKPDD$ | (SEQ ID NO: 1237) |
| *LSTAADMWAVVTDGLASGLDKDYLKPDD$ | (SEQ ID NO: 1238) |
| LSWAADMWAVVTDGLASGLDKDYLKPDD$ | (SEQ ID NO: 1239) |

TABLE 3-continued

| Modified Curedoxin-Derived Peptides | |
|---|---|
| *LSWAADMWAVVTDGLASGLDKDYLKPDD$ | (SEQ ID NO: 1240) |
| LSTAADLWAVVTDGLASGLDKDYLKPDD$ | (SEQ ID NO: 1241) |
| *LSTAADLWAVVTDGLASGLDKDYLKPDD$ | (SEQ ID NO: 1242) |
| LSWAADLWAVVTDGLASGLDKDYLKPDD$ | (SEQ ID NO: 1243) |
| *LSWAADLWAVVTDGLASGLDKDYLKPDD$ | (SEQ ID NO: 1244) |
| LSTAADVWAVVTDGLASGLDKDYLKPDD$ | (SEQ ID NO: 1245) |
| *LSTAADVWAVVTDGLASGLDKDYLKPDD$ | (SEQ ID NO: 1246) |
| LSWAADVWAVVTDGLASGLDKDYLKPDD$ | (SEQ ID NO: 1247) |
| *LSWAADVWAVVTDGLASGLDKDYLKPDD$ | (SEQ ID NO: 1248) |
| LSTAADMQGVVWDGLASGLDKDYLKPDD$ | (SEQ ID NO: 1249) |
| *LSTAADMQGVVWDGLASGLDKDYLKPDD$ | (SEQ ID NO: 1250) |
| LSWAADMQGVVWDGLASGLDKDYLKPDD$ | (SEQ ID NO: 1251) |
| *LSWAADMQGVVWDGLASGLDKDYLKPDD$ | (SEQ ID NO: 1252) |
| LSTAADLQGVVWDGLASGLDKDYLKPDD$ | (SEQ ID NO: 1253) |
| *LSTAADLQGVVWDGLASGLDKDYLKPDD$ | (SEQ ID NO: 1254) |
| LSWAADLQGVVWDGLASGLDKDYLKPDD$ | (SEQ ID NO: 1255) |
| *LSWAADLQGVVWDGLASGLDKDYLKPDD$ | (SEQ ID NO: 1256) |
| LSTAADVQGVVWDGLASGLDKDYLKPDD$ | (SEQ ID NO: 1257) |
| *LSTAADVQGVVWDGLASGLDKDYLKPDD$ | (SEQ ID NO: 1258) |
| LSWAADVQGVVWDGLASGLDKDYLKPDD$ | (SEQ ID NO: 1259) |
| *LSWAADVQGVVWDGLASGLDKDYLKPDD$ | (SEQ ID NO: 1260) |
| LSTAADMWGVVWDGLASGLDKDYLKPDD$ | (SEQ ID NO: 1261) |
| *LSTAADMWGVVWDGLASGLDKDYLKPDD$ | (SEQ ID NO: 1262) |
| LSWAADMWGVVWDGLASGLDKDYLKPDD$ | (SEQ ID NO: 1263) |
| *LSWAADMWGVVWDGLASGLDKDYLKPDD$ | (SEQ ID NO: 1264) |
| LSTAADLWGVVWDGLASGLDKDYLKPDD$ | (SEQ ID NO: 1265) |
| *LSTAADLWGVVWDGLASGLDKDYLKPDD$ | (SEQ ID NO: 1266) |
| LSWAADLWGVVWDGLASGLDKDYLKPDD$ | (SEQ ID NO: 1267) |
| *LSWAADLWGVVWDGLASGLDKDYLKPDD$ | (SEQ ID NO: 1268) |
| LSTAADVWGVVWDGLASGLDKDYLKPDD$ | (SEQ ID NO: 1269) |
| *LSTAADVWGVVWDGLASGLDKDYLKPDD$ | (SEQ ID NO: 1270) |
| LSWAADVWGVVWDGLASGLDKDYLKPDD$ | (SEQ ID NO: 1271) |
| *LSWAADVWGVVWDGLASGLDKDYLKPDD$ | (SEQ ID NO: 1272) |
| LSTAADMQAVVWDGLASGLDKDYLKPDD$ | (SEQ ID NO: 1273) |
| *LSTAADMQAVVWDGLASGLDKDYLKPDD$ | (SEQ ID NO: 1274) |
| LSWAADMQAVVWDGLASGLDKDYLKPDD$ | (SEQ ID NO: 1275) |
| *LSWAADMQAVVWDGLASGLDKDYLKPDD$ | (SEQ ID NO: 1276) |
| LSTAADLQAVVWDGLASGLDKDYLKPDD$ | (SEQ ID NO: 1277) |
| *LSTAADLQAVVWDGLASGLDKDYLKPDD$ | (SEQ ID NO: 1278) |

TABLE 3-continued

| Modified Curedoxin-Derived Peptides | |
|---|---|
| LSWAADLQAVVWDGLASGLDKDYLKPDD$ | (SEQ ID NO: 1279) |
| *LSWAADLQAVVWDGLASGLDKDYLKPDD$ | (SEQ ID NO: 1280) |
| LSTAADVQAVVWDGLASGLDKDYLKPDD$ | (SEQ ID NO: 1281) |
| *LSTAADVQAVVWDGLASGLDKDYLKPDD$ | (SEQ ID NO: 1282) |
| LSWAADVQAVVWDGLASGLDKDYLKPDD$ | (SEQ ID NO: 1283) |
| *LSWAADVQAVVWDGLASGLDKDYLKPDD$ | (SEQ ID NO: 1284) |
| LSTAADMWAVVWDGLASGLDKDYLKPDD$ | (SEQ ID NO: 1285) |
| *LSTAADMWAVVWDGLASGLDKDYLKPDD$ | (SEQ ID NO: 1286) |
| LSWAADMWAVVWDGLASGLDKDYLKPDD$ | (SEQ ID NO: 1287) |
| *LSWAADMWAVVWDGLASGLDKDYLKPDD$ | (SEQ ID NO: 1288) |
| LSTAADLWAVVWDGLASGLDKDYLKPDD$ | (SEQ ID NO: 1289) |
| *LSTAADLWAVVWDGLASGLDKDYLKPDD$ | (SEQ ID NO: 1290) |
| LSWAADLWAVVWDGLASGLDKDYLKPDD$ | (SEQ ID NO: 1291) |
| *LSWAADLWAVVWDGLASGLDKDYLKPDD$ | (SEQ ID NO: 1292) |
| LSTAADVWAVVWDGLASGLDKDYLKPDD$ | (SEQ ID NO: 1293) |
| *LSTAADVWAVVWDGLASGLDKDYLKPDD$ | (SEQ ID NO: 1294) |
| LSWAADVWAVVWDGLASGLDKDYLKPDD$ | (SEQ ID NO: 1295) |
| *LSWAADVWAVVWDGLASGLDKDYLKPDD$ | (SEQ ID NO: 1296) |
| LSTAADMQGVVTDTLASGLDKDYLKPDD$ | (SEQ ID NO: 1297) |
| *LSTAADMQGVVTDTLASGLDKDYLKPDD$ | (SEQ ID NO: 1298) |
| LSWAADMQGVVTDTLASGLDKDYLKPDD$ | (SEQ ID NO: 1299) |
| *LSWAADMQGVVTDTLASGLDKDYLKPDD$ | (SEQ ID NO: 1300) |
| LSTAADLQGVVTDTLASGLDKDYLKPDD$ | (SEQ ID NO: 1301) |
| *LSTAADLQGVVTDTLASGLDKDYLKPDD$ | (SEQ ID NO: 1302) |
| LSWAADLQGVVTDTLASGLDKDYLKPDD$ | (SEQ ID NO: 1303) |
| *LSWAADLQGVVTDTLASGLDKDYLKPDD$ | (SEQ ID NO: 1304) |
| LSTAADVQGVVTDTLASGLDKDYLKPDD$ | (SEQ ID NO: 1305) |
| *LSTAADVQGVVTDTLASGLDKDYLKPDD$ | (SEQ ID NO: 1306) |
| LSWAADVQGVVTDTLASGLDKDYLKPDD$ | (SEQ ID NO: 1307) |
| *LSWAADVQGVVTDTLASGLDKDYLKPDD$ | (SEQ ID NO: 1308) |
| LSTAADMWGVVTDTLASGLDKDYLKPDD$ | (SEQ ID NO: 1309) |
| *LSTAADMWGVVTDTLASGLDKDYLKPDD$ | (SEQ ID NO: 1310) |
| LSWAADMWGVVTDTLASGLDKDYLKPDD$ | (SEQ ID NO: 1311) |
| *LSWAADMWGVVTDTLASGLDKDYLKPDD$ | (SEQ ID NO: 1312) |
| LSTAADLWGVVTDTLASGLDKDYLKPDD$ | (SEQ ID NO: 1313) |
| *LSTAADLWGVVTDTLASGLDKDYLKPDD$ | (SEQ ID NO: 1314) |
| LSWAADLWGVVTDTLASGLDKDYLKPDD$ | (SEQ ID NO: 1315) |
| *LSWAADLWGVVTDTLASGLDKDYLKPDD$ | (SEQ ID NO: 1316) |
| LSTAADVWGVVTDTLASGLDKDYLKPDD$ | (SEQ ID NO: 1317) |

TABLE 3-continued

| Modified Curedoxin-Derived Peptides | |
|---|---|
| *LSTAADVWGVVTDTLASGLDKDYLKPDD$ | (SEQ ID NO: 1318) |
| LSWAADVWGVVTDTLASGLDKDYLKPDD$ | (SEQ ID NO: 1319) |
| *LSWAADVWGVVTDTLASGLDKDYLKPDD$ | (SEQ ID NO: 1320) |
| LSTAADMQAVVTDTLASGLDKDYLKPDD$ | (SEQ ID NO: 1321) |
| *LSTAADMQAVVTDTLASGLDKDYLKPDD$ | (SEQ ID NO: 1322) |
| LSWAADMQAVVTDTLASGLDKDYLKPDD$ | (SEQ ID NO: 1323) |
| *LSWAADMQAVVTDTLASGLDKDYLKPDD$ | (SEQ ID NO: 1324) |
| LSTAADLQAVVTDTLASGLDKDYLKPDD$ | (SEQ ID NO: 1325) |
| *LSTAADLQAVVTDTLASGLDKDYLKPDD$ | (SEQ ID NO: 1326) |
| LSWAADLQAVVTDTLASGLDKDYLKPDD$ | (SEQ ID NO: 1327) |
| *LSWAADLQAVVTDTLASGLDKDYLKPDD$ | (SEQ ID NO: 1328) |
| LSTAADVQAVVTDTLASGLDKDYLKPDD$ | (SEQ ID NO: 1329) |
| *LSTAADVQAVVTDTLASGLDKDYLKPDD$ | (SEQ ID NO: 1330) |
| LSWAADVQAVVTDTLASGLDKDYLKPDD$ | (SEQ ID NO: 1331) |
| *LSWAADVQAVVTDTLASGLDKDYLKPDD$ | (SEQ ID NO: 1332) |
| LSTAADMWAVVTDTLASGLDKDYLKPDD$ | (SEQ ID NO: 1333) |
| *LSTAADMWAVVTDTLASGLDKDYLKPDD$ | (SEQ ID NO: 1334) |
| LSWAADMWAVVTDTLASGLDKDYLKPDD$ | (SEQ ID NO: 1335) |
| *LSWAADMWAVVTDTLASGLDKDYLKPDD$ | (SEQ ID NO: 1336) |
| LSTAADLWAVVTDTLASGLDKDYLKPDD$ | (SEQ ID NO: 1337) |
| *LSTAADLWAVVTDTLASGLDKDYLKPDD$ | (SEQ ID NO: 1338) |
| LSWAADLWAVVTDTLASGLDKDYLKPDD$ | (SEQ ID NO: 1339) |
| *LSWAADLWAVVTDTLASGLDKDYLKPDD$ | (SEQ ID NO: 1340) |
| LSTAADVWAVVTDTLASGLDKDYLKPDD$ | (SEQ ID NO: 1341) |
| *LSTAADVWAVVTDTLASGLDKDYLKPDD$ | (SEQ ID NO: 1342) |
| LSWAADVWAVVTDTLASGLDKDYLKPDD$ | (SEQ ID NO: 1343) |
| *LSWAADVWAVVTDTLASGLDKDYLKPDD$ | (SEQ ID NO: 1344) |
| LSTAADMQGVVWDTLASGLDKDYLKPDD$ | (SEQ ID NO: 1345) |
| *LSTAADMQGVVWDTLASGLDKDYLKPDD$ | (SEQ ID NO: 1346) |
| LSWAADMQGVVWDTLASGLDKDYLKPDD$ | (SEQ ID NO: 1347) |
| *LSWAADMQGVVWDTLASGLDKDYLKPDD$ | (SEQ ID NO: 1348) |
| LSTAADLQGVVWDTLASGLDKDYLKPDD$ | (SEQ ID NO: 1349) |
| *LSTAADLQGVVWDTLASGLDKDYLKPDD$ | (SEQ ID NO: 1350) |
| LSWAADLQGVVWDTLASGLDKDYLKPDD$ | (SEQ ID NO: 1351) |
| *LSWAADLQGVVWDTLASGLDKDYLKPDD$ | (SEQ ID NO: 1352) |
| LSTAADVQGVVWDTLASGLDKDYLKPDD$ | (SEQ ID NO: 1353) |
| *LSTAADVQGVVWDTLASGLDKDYLKPDD$ | (SEQ ID NO: 1354) |
| LSWAADVQGVVWDTLASGLDKDYLKPDD$ | (SEQ ID NO: 1355) |
| *LSWAADVQGVVWDTLASGLDKDYLKPDD$ | (SEQ ID NO: 1356) |

TABLE 3-continued

| Modified Curedoxin-Derived Peptides | |
|---|---|
| LSTAADMWGVVWDTLASGLDKDYLKPDD$ | (SEQ ID NO: 1357) |
| *LSTAADMWGVVWDTLASGLDKDYLKPDD$ | (SEQ ID NO: 1358) |
| LSWAADMWGVVWDTLASGLDKDYLKPDD$ | (SEQ ID NO: 1359) |
| *LSWAADMWGVVWDTLASGLDKDYLKPDD$ | (SEQ ID NO: 1360) |
| LSTAADLWGVVWDTLASGLDKDYLKPDD$ | (SEQ ID NO: 1361) |
| *LSTAADLWGVVWDTLASGLDKDYLKPDD$ | (SEQ ID NO: 1362) |
| LSWAADLWGVVWDTLASGLDKDYLKPDD$ | (SEQ ID NO: 1363) |
| *LSWAADLWGVVWDTLASGLDKDYLKPDD$ | (SEQ ID NO: 1364) |
| LSTAADVWGVVWDTLASGLDKDYLKPDD$ | (SEQ ID NO: 1365) |
| *LSTAADVWGVVWDTLASGLDKDYLKPDD$ | (SEQ ID NO: 1366) |
| LSWAADVWGVVWDTLASGLDKDYLKPDD$ | (SEQ ID NO: 1367) |
| *LSWAADVWGVVWDTLASGLDKDYLKPDD$ | (SEQ ID NO: 1368) |
| LSTAADMQAVVWDTLASGLDKDYLKPDD$ | (SEQ ID NO: 1369) |
| *LSTAADMQAVVWDTLASGLDKDYLKPDD$ | (SEQ ID NO: 1370) |
| LSWAADMQAVVWDTLASGLDKDYLKPDD$ | (SEQ ID NO: 1371) |
| *LSWAADMQAVVWDTLASGLDKDYLKPDD$ | (SEQ ID NO: 1372) |
| LSTAADLQAVVWDTLASGLDKDYLKPDD$ | (SEQ ID NO: 1373) |
| *LSTAADLQAVVWDTLASGLDKDYLKPDD$ | (SEQ ID NO: 1374) |
| LSWAADLQAVVWDTLASGLDKDYLKPDD$ | (SEQ ID NO: 1375) |
| *LSWAADLQAVVWDTLASGLDKDYLKPDD$ | (SEQ ID NO: 1376) |
| LSTAADVQAVVWDTLASGLDKDYLKPDD$ | (SEQ ID NO: 1377) |
| *LSTAADVQAVVWDTLASGLDKDYLKPDD$ | (SEQ ID NO: 1378) |
| LSWAADVQAVVWDTLASGLDKDYLKPDD$ | (SEQ ID NO: 1379) |
| *LSWAADVQAVVWDTLASGLDKDYLKPDD$ | (SEQ ID NO: 1380) |
| LSTAADMWAVVWDTLASGLDKDYLKPDD$ | (SEQ ID NO: 1381) |
| *LSTAADMWAVVWDTLASGLDKDYLKPDD$ | (SEQ ID NO: 1382) |
| LSWAADMWAVVWDTLASGLDKDYLKPDD$ | (SEQ ID NO: 1383) |
| *LSWAADMWAVVWDTLASGLDKDYLKPDD$ | (SEQ ID NO: 1384) |
| LSTAADLWAVVWDTLASGLDKDYLKPDD$ | (SEQ ID NO: 1385) |
| *LSTAADLWAVVWDTLASGLDKDYLKPDD$ | (SEQ ID NO: 1386) |
| LSWAADLWAVVWDTLASGLDKDYLKPDD$ | (SEQ ID NO: 1387) |
| *LSWAADLWAVVWDTLASGLDKDYLKPDD$ | (SEQ ID NO: 1388) |
| LSTAADVWAVVWDTLASGLDKDYLKPDD$ | (SEQ ID NO: 1389) |
| *LSTAADVWAVVWDTLASGLDKDYLKPDD$ | (SEQ ID NO: 1390) |
| LSWAADVWAVVWDTLASGLDKDYLKPDD$ | (SEQ ID NO: 1391) |
| *LSWAADVWAVVWDTLASGLDKDYLKPDD$ | (SEQ ID NO: 1392) |
| LSTAADMQGVVTDWLASGLDKDYLKPDD$ | (SEQ ID NO: 1393) |
| *LSTAADMQGVVTDWLASGLDKDYLKPDD$ | (SEQ ID NO: 1394) |
| LSWAADMQGVVTDWLASGLDKDYLKPDD$ | (SEQ ID NO: 1395) |

TABLE 3-continued

| Modified Curedoxin-Derived Peptides | |
|---|---|
| *LSWAADMQGVVTDWLASGLDKDYLKPDD$ | (SEQ ID NO: 1396) |
| LSTAADLQGVVTDWLASGLDKDYLKPDD$ | (SEQ ID NO: 1397) |
| *LSTAADLQGVVTDWLASGLDKDYLKPDD$ | (SEQ ID NO: 1398) |
| LSWAADLQGVVTDWLASGLDKDYLKPDD$ | (SEQ ID NO: 1399) |
| *LSWAADLQGVVTDWLASGLDKDYLKPDD$ | (SEQ ID NO: 1400) |
| LSTAADVQGVVTDWLASGLDKDYLKPDD$ | (SEQ ID NO: 1401) |
| *LSTAADVQGVVTDWLASGLDKDYLKPDD$ | (SEQ ID NO: 1402) |
| LSWAADVQGVVTDWLASGLDKDYLKPDD$ | (SEQ ID NO: 1403) |
| *LSWAADVQGVVTDWLASGLDKDYLKPDD$ | (SEQ ID NO: 1404) |
| LSTAADMWGVVTDWLASGLDKDYLKPDD$ | (SEQ ID NO: 1405) |
| *LSTAADMWGVVTDWLASGLDKDYLKPDD$ | (SEQ ID NO: 1406) |
| LSWAADMWGVVTDWLASGLDKDYLKPDD$ | (SEQ ID NO: 1407) |
| *LSWAADMWGVVTDWLASGLDKDYLKPDD$ | (SEQ ID NO: 1408) |
| LSTAADLWGVVTDWLASGLDKDYLKPDD$ | (SEQ ID NO: 1409) |
| *LSTAADLWGVVTDWLASGLDKDYLKPDD$ | (SEQ ID NO: 1410) |
| LSWAADLWGVVTDWLASGLDKDYLKPDD$ | (SEQ ID NO: 1411) |
| *LSWAADLWGVVTDWLASGLDKDYLKPDD$ | (SEQ ID NO: 1412) |
| LSTAADVWGVVTDWLASGLDKDYLKPDD$ | (SEQ ID NO: 1413) |
| *LSTAADVWGVVTDWLASGLDKDYLKPDD$ | (SEQ ID NO: 1414) |
| LSWAADVWGVVTDWLASGLDKDYLKPDD$ | (SEQ ID NO: 1415) |
| *LSWAADVWGVVTDWLASGLDKDYLKPDD$ | (SEQ ID NO: 1416) |
| LSTAADMQAVVTDWLASGLDKDYLKPDD$ | (SEQ ID NO: 1417) |
| *LSTAADMQAVVTDWLASGLDKDYLKPDD$ | (SEQ ID NO: 1418) |
| LSWAADMQAVVTDWLASGLDKDYLKPDD$ | (SEQ ID NO: 1419) |
| *LSWAADMQAVVTDWLASGLDKDYLKPDD$ | (SEQ ID NO: 1420) |
| LSTAADLQAVVTDWLASGLDKDYLKPDD$ | (SEQ ID NO: 1421) |
| *LSTAADLQAVVTDWLASGLDKDYLKPDD$ | (SEQ ID NO: 1422) |
| LSWAADLQAVVTDWLASGLDKDYLKPDD$ | (SEQ ID NO: 1423) |
| *LSWAADLQAVVTDWLASGLDKDYLKPDD$ | (SEQ ID NO: 1424) |
| LSTAADVQAVVTDWLASGLDKDYLKPDD$ | (SEQ ID NO: 1425) |
| *LSTAADVQAVVTDWLASGLDKDYLKPDD$ | (SEQ ID NO: 1426) |
| LSWAADVQAVVTDWLASGLDKDYLKPDD$ | (SEQ ID NO: 1427) |
| *LSWAADVQAVVTDWLASGLDKDYLKPDD$ | (SEQ ID NO: 1428) |
| LSTAADMWAVVTDWLASGLDKDYLKPDD$ | (SEQ ID NO: 1429) |
| *LSTAADMWAVVTDWLASGLDKDYLKPDD$ | (SEQ ID NO: 1430) |
| LSWAADMWAVVTDWLASGLDKDYLKPDD$ | (SEQ ID NO: 1431) |
| *LSWAADMWAVVTDWLASGLDKDYLKPDD$ | (SEQ ID NO: 1432) |
| LSTAADLWAVVTDWLASGLDKDYLKPDD$ | (SEQ ID NO: 1433) |
| *LSTAADLWAVVTDWLASGLDKDYLKPDD$ | (SEQ ID NO: 1434) |

TABLE 3-continued

| Modified Curedoxin-Derived Peptides | |
|---|---|
| LSWAADLWAVVTDWLASGLDKDYLKPDD$ | (SEQ ID NO: 1435) |
| *LSWAADLWAVVTDWLASGLDKDYLKPDD$ | (SEQ ID NO: 1436) |
| LSTAADVWAVVTDWLASGLDKDYLKPDD$ | (SEQ ID NO: 1437) |
| *LSTAADVWAVVTDWLASGLDKDYLKPDD$ | (SEQ ID NO: 1438) |
| LSWAADVWAVVTDWLASGLDKDYLKPDD$ | (SEQ ID NO: 1439) |
| *LSWAADVWAVVTDWLASGLDKDYLKPDD$ | (SEQ ID NO: 1440) |
| LSTAADMQGVVWDWLASGLDKDYLKPDD$ | (SEQ ID NO: 1441) |
| *LSTAADMQGVVWDWLASGLDKDYLKPDD$ | (SEQ ID NO: 1442) |
| LSWAADMQGVVWDWLASGLDKDYLKPDD$ | (SEQ ID NO: 1443) |
| *LSWAADMQGVVWDWLASGLDKDYLKPDD$ | (SEQ ID NO: 1444) |
| LSTAADLQGVVWDWLASGLDKDYLKPDD$ | (SEQ ID NO: 1445) |
| *LSTAADLQGVVWDWLASGLDKDYLKPDD$ | (SEQ ID NO: 1446) |
| LSWAADLQGVVWDWLASGLDKDYLKPDD$ | (SEQ ID NO: 1447) |
| *LSWAADLQGVVWDWLASGLDKDYLKPDD$ | (SEQ ID NO: 1448) |
| LSTAADVQGVVWDWLASGLDKDYLKPDD$ | (SEQ ID NO: 1449) |
| *LSTAADVQGVVWDWLASGLDKDYLKPDD$ | (SEQ ID NO: 1450) |
| LSWAADVQGVVWDWLASGLDKDYLKPDD$ | (SEQ ID NO: 1451) |
| *LSWAADVQGVVWDWLASGLDKDYLKPDD$ | (SEQ ID NO: 1452) |
| LSTAADMWGVVWDWLASGLDKDYLKPDD$ | (SEQ ID NO: 1453) |
| *LSTAADMWGVVWDWLASGLDKDYLKPDD$ | (SEQ ID NO: 1454) |
| LSWAADMWGVVWDWLASGLDKDYLKPDD$ | (SEQ ID NO: 1455) |
| *LSWAADMWGVVWDWLASGLDKDYLKPDD$ | (SEQ ID NO: 1456) |
| LSTAADLWGVVWDWLASGLDKDYLKPDD$ | (SEQ ID NO: 1457) |
| *LSTAADLWGVVWDWLASGLDKDYLKPDD$ | (SEQ ID NO: 1458) |
| LSWAADLWGVVWDWLASGLDKDYLKPDD$ | (SEQ ID NO: 1459) |
| *LSWAADLWGVVWDWLASGLDKDYLKPDD$ | (SEQ ID NO: 1460) |
| LSTAADVWGVVWDWLASGLDKDYLKPDD$ | (SEQ ID NO: 1461) |
| *LSTAADVWGVVWDWLASGLDKDYLKPDD$ | (SEQ ID NO: 1462) |
| LSWAADVWGVVWDWLASGLDKDYLKPDD$ | (SEQ ID NO: 1463) |
| *LSWAADVWGVVWDWLASGLDKDYLKPDD$ | (SEQ ID NO: 1464) |
| LSTAADMQAVVWDWLASGLDKDYLKPDD$ | (SEQ ID NO: 1465) |
| *LSTAADMQAVVWDWLASGLDKDYLKPDD$ | (SEQ ID NO: 1466) |
| LSWAADMQAVVWDWLASGLDKDYLKPDD$ | (SEQ ID NO: 1467) |
| *LSWAADMQAVVWDWLASGLDKDYLKPDD$ | (SEQ ID NO: 1468) |
| LSTAADLQAVVWDWLASGLDKDYLKPDD$ | (SEQ ID NO: 1469) |
| *LSTAADLQAVVWDWLASGLDKDYLKPDD$ | (SEQ ID NO: 1470) |
| LSWAADLQAVVWDWLASGLDKDYLKPDD$ | (SEQ ID NO: 1471) |
| *LSWAADLQAVVWDWLASGLDKDYLKPDD$ | (SEQ ID NO: 1472) |
| LSTAADVQAVVWDWLASGLDKDYLKPDD$ | (SEQ ID NO: 1473) |

TABLE 3-continued

| Modified Curedoxin-Derived Peptides | |
|---|---|
| *LSTAADVQAVVWDWLASGLDKDYLKPDD$ | (SEQ ID NO: 1474) |
| LSWAADVQAVVWDWLASGLDKDYLKPDD$ | (SEQ ID NO: 1475) |
| *LSWAADVQAVVWDWLASGLDKDYLKPDD$ | (SEQ ID NO: 1476) |
| LSTAADMWAVVWDWLASGLDKDYLKPDD$ | (SEQ ID NO: 1477) |
| *LSTAADMWAVVWDWLASGLDKDYLKPDD$ | (SEQ ID NO: 1478) |
| LSWAADMWAVVWDWLASGLDKDYLKPDD$ | (SEQ ID NO: 1479) |
| *LSWAADMWAVVWDWLASGLDKDYLKPDD$ | (SEQ ID NO: 1480) |
| LSTAADLWAVVWDWLASGLDKDYLKPDD$ | (SEQ ID NO: 1481) |
| *LSTAADLWAVVWDWLASGLDKDYLKPDD$ | (SEQ ID NO: 1482) |
| LSWAADLWAVVWDWLASGLDKDYLKPDD$ | (SEQ ID NO: 1483) |
| *LSWAADLWAVVWDWLASGLDKDYLKPDD$ | (SEQ ID NO: 1484) |
| LSTAADVWAVVWDWLASGLDKDYLKPDD$ | (SEQ ID NO: 1485) |
| *LSTAADVWAVVWDWLASGLDKDYLKPDD$ | (SEQ ID NO: 1486) |
| LSWAADVWAVVWDWLASGLDKDYLKPDD$ | (SEQ ID NO: 1487) |
| *LSWAADVWAVVWDWLASGLDKDYLKPDD$ | (SEQ ID NO: 1488) |
| LSTAADMQGVVTDGVASGLDKDYLKPDD$ | (SEQ ID NO: 1489) |
| *LSTAADMQGVVTDGVASGLDKDYLKPDD$ | (SEQ ID NO: 1490) |
| LSWAADMQGVVTDGVASGLDKDYLKPDD$ | (SEQ ID NO: 1491) |
| *LSWAADMQGVVTDGVASGLDKDYLKPDD$ | (SEQ ID NO: 1492) |
| LSTAADLQGVVTDGVASGLDKDYLKPDD$ | (SEQ ID NO: 1493) |
| *LSTAADLQGVVTDGVASGLDKDYLKPDD$ | (SEQ ID NO: 1494) |
| LSWAADLQGVVTDGVASGLDKDYLKPDD$ | (SEQ ID NO: 1495) |
| *LSWAADLQGVVTDGVASGLDKDYLKPDD$ | (SEQ ID NO: 1496) |
| LSTAADVQGVVTDGVASGLDKDYLKPDD$ | (SEQ ID NO: 1497) |
| *LSTAADVQGVVTDGVASGLDKDYLKPDD$ | (SEQ ID NO: 1498) |
| LSWAADVQGVVTDGVASGLDKDYLKPDD$ | (SEQ ID NO: 1499) |
| *LSWAADVQGVVTDGVASGLDKDYLKPDD$ | (SEQ ID NO: 1500) |
| LSTAADMWGVVTDGVASGLDKDYLKPDD$ | (SEQ ID NO: 1501) |
| *LSTAADMWGVVTDGVASGLDKDYLKPDD$ | (SEQ ID NO: 1502) |
| LSWAADMWGVVTDGVASGLDKDYLKPDD$ | (SEQ ID NO: 1503) |
| *LSWAADMWGVVTDGVASGLDKDYLKPDD$ | (SEQ ID NO: 1504) |
| LSTAADLWGVVTDGVASGLDKDYLKPDD$ | (SEQ ID NO: 1505) |
| *LSTAADLWGVVTDGVASGLDKDYLKPDD$ | (SEQ ID NO: 1506) |
| LSWAADLWGVVTDGVASGLDKDYLKPDD$ | (SEQ ID NO: 1507) |
| *LSWAADLWGVVTDGVASGLDKDYLKPDD$ | (SEQ ID NO: 1508) |
| LSTAADVWGVVTDGVASGLDKDYLKPDD$ | (SEQ ID NO: 1509) |
| *LSTAADVWGVVTDGVASGLDKDYLKPDD$ | (SEQ ID NO: 1510) |
| LSWAADVWGVVTDGVASGLDKDYLKPDD$ | (SEQ ID NO: 1511) |
| *LSWAADVWGVVTDGVASGLDKDYLKPDD$ | (SEQ ID NO: 1512) |

TABLE 3-continued

| Modified Curedoxin-Derived Peptides | |
|---|---|
| LSTAADMQAVVTDGVASGLDKDYLKPDD$ | (SEQ ID NO: 1513) |
| *LSTAADMQAVVTDGVASGLDKDYLKPDD$ | (SEQ ID NO: 1514) |
| LSWAADMQAVVTDGVASGLDKDYLKPDD$ | (SEQ ID NO: 1515) |
| *LSWAADMQAVVTDGVASGLDKDYLKPDD$ | (SEQ ID NO: 1516) |
| LSTAADLQAVVTDGVASGLDKDYLKPDD$ | (SEQ ID NO: 1517) |
| *LSTAADLQAVVTDGVASGLDKDYLKPDD$ | (SEQ ID NO: 1518) |
| LSWAADLQAVVTDGVASGLDKDYLKPDD$ | (SEQ ID NO: 1519) |
| *LSWAADLQAVVTDGVASGLDKDYLKPDD$ | (SEQ ID NO: 1520) |
| LSTAADVQAVVTDGVASGLDKDYLKPDD$ | (SEQ ID NO: 1521) |
| *LSTAADVQAVVTDGVASGLDKDYLKPDD$ | (SEQ ID NO: 1522) |
| LSWAADVQAVVTDGVASGLDKDYLKPDD$ | (SEQ ID NO: 1523) |
| *LSWAADVQAVVTDGVASGLDKDYLKPDD$ | (SEQ ID NO: 1524) |
| LSTAADMWAVVTDGVASGLDKDYLKPDD$ | (SEQ ID NO: 1525) |
| *LSTAADMWAVVTDGVASGLDKDYLKPDD$ | (SEQ ID NO: 1526) |
| LSWAADMWAVVTDGVASGLDKDYLKPDD$ | (SEQ ID NO: 1527) |
| *LSWAADMWAVVTDGVASGLDKDYLKPDD$ | (SEQ ID NO: 1528) |
| LSTAADLWAVVTDGVASGLDKDYLKPDD$ | (SEQ ID NO: 1529) |
| *LSTAADLWAVVTDGVASGLDKDYLKPDD$ | (SEQ ID NO: 1530) |
| LSWAADLWAVVTDGVASGLDKDYLKPDD$ | (SEQ ID NO: 1531) |
| *LSWAADLWAVVTDGVASGLDKDYLKPDD$ | (SEQ ID NO: 1532) |
| LSTAADVWAVVTDGVASGLDKDYLKPDD$ | (SEQ ID NO: 1533) |
| *LSTAADVWAVVTDGVASGLDKDYLKPDD$ | (SEQ ID NO: 1534) |
| LSWAADVWAVVTDGVASGLDKDYLKPDD$ | (SEQ ID NO: 1535) |
| *LSWAADVWAVVTDGVASGLDKDYLKPDD$ | (SEQ ID NO: 1536) |
| LSTAADMQGVVWDGVASGLDKDYLKPDD$ | (SEQ ID NO: 1537) |
| *LSTAADMQGVVWDGVASGLDKDYLKPDD$ | (SEQ ID NO: 1538) |
| LSWAADMQGVVWDGVASGLDKDYLKPDD$ | (SEQ ID NO: 1539) |
| *LSWAADMQGVVWDGVASGLDKDYLKPDD$ | (SEQ ID NO: 1540) |
| LSTAADLQGVVWDGVASGLDKDYLKPDD$ | (SEQ ID NO: 1541) |
| *LSTAADLQGVVWDGVASGLDKDYLKPDD$ | (SEQ ID NO: 1542) |
| LSWAADLQGVVWDGVASGLDKDYLKPDD$ | (SEQ ID NO: 1543) |
| *LSWAADLQGVVWDGVASGLDKDYLKPDD$ | (SEQ ID NO: 1544) |
| LSTAADVQGVVWDGVASGLDKDYLKPDD$ | (SEQ ID NO: 1545) |
| *LSTAADVQGVVWDGVASGLDKDYLKPDD$ | (SEQ ID NO: 1546) |
| LSWAADVQGVVWDGVASGLDKDYLKPDD$ | (SEQ ID NO: 1547) |
| *LSWAADVQGVVWDGVASGLDKDYLKPDD$ | (SEQ ID NO: 1548) |
| LSTAADMWGVVWDGVASGLDKDYLKPDD$ | (SEQ ID NO: 1549) |
| *LSTAADMWGVVWDGVASGLDKDYLKPDD$ | (SEQ ID NO: 1550) |
| LSWAADMWGVVWDGVASGLDKDYLKPDD$ | (SEQ ID NO: 1551) |

TABLE 3-continued

| Modified Curedoxin-Derived Peptides | |
|---|---|
| *LSWAADMWGVVWDGVASGLDKDYLKPDD$ | (SEQ ID NO: 1552) |
| LSTAADLWGVVWDGVASGLDKDYLKPDD$ | (SEQ ID NO: 1553) |
| *LSTAADLWGVVWDGVASGLDKDYLKPDD$ | (SEQ ID NO: 1554) |
| LSWAADLWGVVWDGVASGLDKDYLKPDD$ | (SEQ ID NO: 1555) |
| *LSWAADLWGVVWDGVASGLDKDYLKPDD$ | (SEQ ID NO: 1556) |
| LSTAADVWGVVWDGVASGLDKDYLKPDD$ | (SEQ ID NO: 1557) |
| *LSTAADVWGVVWDGVASGLDKDYLKPDD$ | (SEQ ID NO: 1558) |
| LSWAADVWGVVWDGVASGLDKDYLKPDD$ | (SEQ ID NO: 1559) |
| *LSWAADVWGVVWDGVASGLDKDYLKPDD$ | (SEQ ID NO: 1560) |
| LSTAADMQAVVWDGVASGLDKDYLKPDD$ | (SEQ ID NO: 1561) |
| *LSTAADMQAVVWDGVASGLDKDYLKPDD$ | (SEQ ID NO: 1562) |
| LSWAADMQAVVWDGVASGLDKDYLKPDD$ | (SEQ ID NO: 1563) |
| *LSWAADMQAVVWDGVASGLDKDYLKPDD$ | (SEQ ID NO: 1564) |
| LSTAADLQAVVWDGVASGLDKDYLKPDD$ | (SEQ ID NO: 1565) |
| *LSTAADLQAVVWDGVASGLDKDYLKPDD$ | (SEQ ID NO: 1566) |
| LSWAADLQAVVWDGVASGLDKDYLKPDD$ | (SEQ ID NO: 1567) |
| *LSWAADLQAVVWDGVASGLDKDYLKPDD$ | (SEQ ID NO: 1568) |
| LSTAADVQAVVWDGVASGLDKDYLKPDD$ | (SEQ ID NO: 1569) |
| *LSTAADVQAVVWDGVASGLDKDYLKPDD$ | (SEQ ID NO: 1570) |
| LSWAADVQAVVWDGVASGLDKDYLKPDD$ | (SEQ ID NO: 1571) |
| *LSWAADVQAVVWDGVASGLDKDYLKPDD$ | (SEQ ID NO: 1572) |
| LSTAADMWAVVWDGVASGLDKDYLKPDD$ | (SEQ ID NO: 1573) |
| *LSTAADMWAVVWDGVASGLDKDYLKPDD$ | (SEQ ID NO: 1574) |
| LSWAADMWAVVWDGVASGLDKDYLKPDD$ | (SEQ ID NO: 1575) |
| *LSWAADMWAVVWDGVASGLDKDYLKPDD$ | (SEQ ID NO: 1576) |
| LSTAADLWAVVWDGVASGLDKDYLKPDD$ | (SEQ ID NO: 1577) |
| *LSTAADLWAVVWDGVASGLDKDYLKPDD$ | (SEQ ID NO: 1578) |
| LSWAADLWAVVWDGVASGLDKDYLKPDD$ | (SEQ ID NO: 1579) |
| *LSWAADLWAVVWDGVASGLDKDYLKPDD$ | (SEQ ID NO: 1580) |
| LSTAADVWAVVWDGVASGLDKDYLKPDD$ | (SEQ ID NO: 1581) |
| *LSTAADVWAVVWDGVASGLDKDYLKPDD$ | (SEQ ID NO: 1582) |
| LSWAADVWAVVWDGVASGLDKDYLKPDD$ | (SEQ ID NO: 1583) |
| *LSWAADVWAVVWDGVASGLDKDYLKPDD$ | (SEQ ID NO: 1584) |
| LSTAADMQGVVTDTVASGLDKDYLKPDD$ | (SEQ ID NO: 1585) |
| *LSTAADMQGVVTDTVASGLDKDYLKPDD$ | (SEQ ID NO: 1586) |
| LSWAADMQGVVTDTVASGLDKDYLKPDD$ | (SEQ ID NO: 1587) |
| *LSWAADMQGVVTDTVASGLDKDYLKPDD$ | (SEQ ID NO: 1588) |
| LSTAADLQGVVTDTVASGLDKDYLKPDD$ | (SEQ ID NO: 1589) |
| *LSTAADLQGVVTDTVASGLDKDYLKPDD$ | (SEQ ID NO: 1590) |

TABLE 3-continued

| Modified Curedoxin-Derived Peptides | |
|---|---|
| LSWAADLQGVVTDTVASGLDKDYLKPDD$ | (SEQ ID NO: 1591) |
| *LSWAADLQGVVTDTVASGLDKDYLKPDD$ | (SEQ ID NO: 1592) |
| LSTAADVQGVVTDTVASGLDKDYLKPDD$ | (SEQ ID NO: 1593) |
| *LSTAADVQGVVTDTVASGLDKDYLKPDD$ | (SEQ ID NO: 1594) |
| LSWAADVQGVVTDTVASGLDKDYLKPDD$ | (SEQ ID NO: 1595) |
| *LSWAADVQGVVTDTVASGLDKDYLKPDD$ | (SEQ ID NO: 1596) |
| LSTAADMWGVVTDTVASGLDKDYLKPDD$ | (SEQ ID NO: 1597) |
| *LSTAADMWGVVTDTVASGLDKDYLKPDD$ | (SEQ ID NO: 1598) |
| LSWAADMWGVVTDTVASGLDKDYLKPDD$ | (SEQ ID NO: 1599) |
| *LSWAADMWGVVTDTVASGLDKDYLKPDD$ | (SEQ ID NO: 1600) |
| LSTAADLWGVVTDTVASGLDKDYLKPDD$ | (SEQ ID NO: 1601) |
| *LSTAADLWGVVTDTVASGLDKDYLKPDD$ | (SEQ ID NO: 1602) |
| LSWAADLWGVVTDTVASGLDKDYLKPDD$ | (SEQ ID NO: 1603) |
| *LSWAADLWGVVTDTVASGLDKDYLKPDD$ | (SEQ ID NO: 1604) |
| LSTAADVWGVVTDTVASGLDKDYLKPDD$ | (SEQ ID NO: 1605) |
| *LSTAADVWGVVTDTVASGLDKDYLKPDD$ | (SEQ ID NO: 1606) |
| LSWAADVWGVVTDTVASGLDKDYLKPDD$ | (SEQ ID NO: 1607) |
| *LSWAADVWGVVTDTVASGLDKDYLKPDD$ | (SEQ ID NO: 1608) |
| LSTAADMQAVVTDTVASGLDKDYLKPDD$ | (SEQ ID NO: 1609) |
| *LSTAADMQAVVTDTVASGLDKDYLKPDD$ | (SEQ ID NO: 1610) |
| LSWAADMQAVVTDTVASGLDKDYLKPDD$ | (SEQ ID NO: 1611) |
| *LSWAADMQAVVTDTVASGLDKDYLKPDD$ | (SEQ ID NO: 1612) |
| LSTAADLQAVVTDTVASGLDKDYLKPDD$ | (SEQ ID NO: 1613) |
| *LSTAADLQAVVTDTVASGLDKDYLKPDD$ | (SEQ ID NO: 1614) |
| LSWAADLQAVVTDTVASGLDKDYLKPDD$ | (SEQ ID NO: 1615) |
| *LSWAADLQAVVTDTVASGLDKDYLKPDD$ | (SEQ ID NO: 1616) |
| LSTAADVQAVVTDTVASGLDKDYLKPDD$ | (SEQ ID NO: 1617) |
| *LSTAADVQAVVTDTVASGLDKDYLKPDD$ | (SEQ ID NO: 1618) |
| LSWAADVQAVVTDTVASGLDKDYLKPDD$ | (SEQ ID NO: 1619) |
| *LSWAADVQAVVTDTVASGLDKDYLKPDD$ | (SEQ ID NO: 1620) |
| LSTAADMWAVVTDTVASGLDKDYLKPDD$ | (SEQ ID NO: 1621) |
| *LSTAADMWAVVTDTVASGLDKDYLKPDD$ | (SEQ ID NO: 1622) |
| LSWAADMWAVVTDTVASGLDKDYLKPDD$ | (SEQ ID NO: 1623) |
| *LSWAADMWAVVTDTVASGLDKDYLKPDD$ | (SEQ ID NO: 1624) |
| LSTAADLWAVVTDTVASGLDKDYLKPDD$ | (SEQ ID NO: 1625) |
| *LSTAADLWAVVTDTVASGLDKDYLKPDD$ | (SEQ ID NO: 1626) |
| LSWAADLWAVVTDTVASGLDKDYLKPDD$ | (SEQ ID NO: 1627) |
| *LSWAADLWAVVTDTVASGLDKDYLKPDD$ | (SEQ ID NO: 1628) |
| LSTAADVWAVVTDTVASGLDKDYLKPDD$ | (SEQ ID NO: 1629) |

TABLE 3-continued

| Modified Curedoxin-Derived Peptides | |
|---|---|
| *LSTAADVWAVVTDTVASGLDKDYLKPDD$ | (SEQ ID NO: 1630) |
| LSWAADVWAVVTDTVASGLDKDYLKPDD$ | (SEQ ID NO: 1631) |
| *LSWAADVWAVVTDTVASGLDKDYLKPDD$ | (SEQ ID NO: 1632) |
| LSTAADMQGVVWDTVASGLDKDYLKPDD$ | (SEQ ID NO: 1633) |
| *LSTAADMQGVVWDTVASGLDKDYLKPDD$ | (SEQ ID NO: 1634) |
| LSWAADMQGVVWDTVASGLDKDYLKPDD$ | (SEQ ID NO: 1635) |
| *LSWAADMQGVVWDTVASGLDKDYLKPDD$ | (SEQ ID NO: 1636) |
| LSTAADLQGVVWDTVASGLDKDYLKPDD$ | (SEQ ID NO: 1637) |
| *LSTAADLQGVVWDTVASGLDKDYLKPDD$ | (SEQ ID NO: 1638) |
| LSWAADLQGVVWDTVASGLDKDYLKPDD$ | (SEQ ID NO: 1639) |
| *LSWAADLQGVVWDTVASGLDKDYLKPDD$ | (SEQ ID NO: 1640) |
| LSTAADVQGVVWDTVASGLDKDYLKPDD$ | (SEQ ID NO: 1641) |
| *LSTAADVQGVVWDTVASGLDKDYLKPDD$ | (SEQ ID NO: 1642) |
| LSWAADVQGVVWDTVASGLDKDYLKPDD$ | (SEQ ID NO: 1643) |
| *LSWAADVQGVVWDTVASGLDKDYLKPDD$ | (SEQ ID NO: 1644) |
| LSTAADMWGVVWDTVASGLDKDYLKPDD$ | (SEQ ID NO: 1645) |
| *LSTAADMWGVVWDTVASGLDKDYLKPDD$ | (SEQ ID NO: 1646) |
| LSWAADMWGVVWDTVASGLDKDYLKPDD$ | (SEQ ID NO: 1647) |
| *LSWAADMWGVVWDTVASGLDKDYLKPDD$ | (SEQ ID NO: 1648) |
| LSTAADLWGVVWDTVASGLDKDYLKPDD$ | (SEQ ID NO: 1649) |
| *LSTAADLWGVVWDTVASGLDKDYLKPDD$ | (SEQ ID NO: 1650) |
| LSWAADLWGVVWDTVASGLDKDYLKPDD$ | (SEQ ID NO: 1651) |
| *LSWAADLWGVVWDTVASGLDKDYLKPDD$ | (SEQ ID NO: 1652) |
| LSTAADVWGVVWDTVASGLDKDYLKPDD$ | (SEQ ID NO: 1653) |
| *LSTAADVWGVVWDTVASGLDKDYLKPDD$ | (SEQ ID NO: 1654) |
| LSWAADVWGVVWDTVASGLDKDYLKPDD$ | (SEQ ID NO: 1655) |
| *LSWAADVWGVVWDTVASGLDKDYLKPDD$ | (SEQ ID NO: 1656) |
| LSTAADMQAVVWDTVASGLDKDYLKPDD$ | (SEQ ID NO: 1657) |
| *LSTAADMQAVVWDTVASGLDKDYLKPDD$ | (SEQ ID NO: 1658) |
| LSWAADMQAVVWDTVASGLDKDYLKPDD$ | (SEQ ID NO: 1659) |
| *LSWAADMQAVVWDTVASGLDKDYLKPDD$ | (SEQ ID NO: 1660) |
| LSTAADLQAVVWDTVASGLDKDYLKPDD$ | (SEQ ID NO: 1661) |
| *LSTAADLQAVVWDTVASGLDKDYLKPDD$ | (SEQ ID NO: 1662) |
| LSWAADLQAVVWDTVASGLDKDYLKPDD$ | (SEQ ID NO: 1663) |
| *LSWAADLQAVVWDTVASGLDKDYLKPDD$ | (SEQ ID NO: 1664) |
| LSTAADVQAVVWDTVASGLDKDYLKPDD$ | (SEQ ID NO: 1665) |
| *LSTAADVQAVVWDTVASGLDKDYLKPDD$ | (SEQ ID NO: 1666) |
| LSWAADVQAVVWDTVASGLDKDYLKPDD$ | (SEQ ID NO: 1667) |
| *LSWAADVQAVVWDTVASGLDKDYLKPDD$ | (SEQ ID NO: 1668) |

TABLE 3-continued

| Modified Curedoxin-Derived Peptides | |
|---|---|
| LSTAADMWAVVWDTVASGLDKDYLKPDD$ | (SEQ ID NO: 1669) |
| *LSTAADMWAVVWDTVASGLDKDYLKPDD$ | (SEQ ID NO: 1670) |
| LSWAADMWAVVWDTVASGLDKDYLKPDD$ | (SEQ ID NO: 1671) |
| *LSWAADMWAVVWDTVASGLDKDYLKPDD$ | (SEQ ID NO: 1672) |
| LSTAADLWAVVWDTVASGLDKDYLKPDD$ | (SEQ ID NO: 1673) |
| *LSTAADLWAVVWDTVASGLDKDYLKPDD$ | (SEQ ID NO: 1674) |
| LSWAADLWAVVWDTVASGLDKDYLKPDD$ | (SEQ ID NO: 1675) |
| *LSWAADLWAVVWDTVASGLDKDYLKPDD$ | (SEQ ID NO: 1676) |
| LSTAADVWAVVWDTVASGLDKDYLKPDD$ | (SEQ ID NO: 1677) |
| *LSTAADVWAVVWDTVASGLDKDYLKPDD$ | (SEQ ID NO: 1678) |
| LSWAADVWAVVWDTVASGLDKDYLKPDD$ | (SEQ ID NO: 1679) |
| *LSWAADVWAVVWDTVASGLDKDYLKPDD$ | (SEQ ID NO: 1680) |
| LSTAADMQGVVTDWVASGLDKDYLKPDD$ | (SEQ ID NO: 1681) |
| *LSTAADMQGVVTDWVASGLDKDYLKPDD$ | (SEQ ID NO: 1682) |
| LSWAADMQGVVTDWVASGLDKDYLKPDD$ | (SEQ ID NO: 1683) |
| *LSWAADMQGVVTDWVASGLDKDYLKPDD$ | (SEQ ID NO: 1684) |
| LSTAADLQGVVTDWVASGLDKDYLKPDD$ | (SEQ ID NO: 1685) |
| *LSTAADLQGVVTDWVASGLDKDYLKPDD$ | (SEQ ID NO: 1686) |
| LSWAADLQGVVTDWVASGLDKDYLKPDD$ | (SEQ ID NO: 1687) |
| *LSWAADLQGVVTDWVASGLDKDYLKPDD$ | (SEQ ID NO: 1688) |
| LSTAADVQGVVTDWVASGLDKDYLKPDD$ | (SEQ ID NO: 1689) |
| *LSTAADVQGVVTDWVASGLDKDYLKPDD$ | (SEQ ID NO: 1690) |
| LSWAADVQGVVTDWVASGLDKDYLKPDD$ | (SEQ ID NO: 1691) |
| *LSWAADVQGVVTDWVASGLDKDYLKPDD$ | (SEQ ID NO: 1692) |
| LSTAADMWGVVTDWVASGLDKDYLKPDD$ | (SEQ ID NO: 1693) |
| *LSTAADMWGVVTDWVASGLDKDYLKPDD$ | (SEQ ID NO: 1694) |
| LSWAADMWGVVTDWVASGLDKDYLKPDD$ | (SEQ ID NO: 1695) |
| *LSWAADMWGVVTDWVASGLDKDYLKPDD$ | (SEQ ID NO: 1696) |
| LSTAADLWGVVTDWVASGLDKDYLKPDD$ | (SEQ ID NO: 1697) |
| *LSTAADLWGVVTDWVASGLDKDYLKPDD$ | (SEQ ID NO: 1698) |
| LSWAADLWGVVTDWVASGLDKDYLKPDD$ | (SEQ ID NO: 1699) |
| *LSWAADLWGVVTDWVASGLDKDYLKPDD$ | (SEQ ID NO: 1700) |
| LSTAADVWGVVTDWVASGLDKDYLKYDD$ | (SEQ ID NO: 1701) |
| *LSTAADVWGVVTDWVASGLDKDYLKPDD$ | (SEQ ID NO: 1702) |
| LSWAADVWGVVTDWVASGLDKDYLKPDD$ | (SEQ ID NO: 1703) |
| *LSWAADVWGVVTDWVASGLDKDYLKPDD$ | (SEQ ID NO: 1704) |
| LSTAADMQAVVTDWVASGLDKDYLKPDD$ | (SEQ ID NO: 1705) |
| *LSTAADMQAVVTDWVASGLDKDYLKPDD$ | (SEQ ID NO: 1706) |
| LSWAADMQAVVTDWVASGLDKDYLKPDD$ | (SEQ ID NO: 1707) |

TABLE 3-continued

| Modified Curedoxin-Derived Peptides | |
|---|---|
| *LSWAADMQAVVTDWVASGLDKDYLKPDD$ | (SEQ ID NO: 1708) |
| LSTAADLQAVVTDWVASGLDKDYLKPDD$ | (SEQ ID NO: 1709) |
| *LSTAADLQAVVTDWVASGLDKDYLKPDD$ | (SEQ ID NO: 1710) |
| LSWAADLQAVVTDWVASGLDKDYLKPDD$ | (SEQ ID NO: 1711) |
| *LSWAADLQAVVTDWVASGLDKDYLKPDD$ | (SEQ ID NO: 1712) |
| LSTAADVQAVVTDWVASGLDKDYLKPDD$ | (SEQ ID NO: 1713) |
| *LSTAADVQAVVTDWVASGLDKDYLKPDD$ | (SEQ ID NO: 1714) |
| LSWAADVQAVVTDWVASGLDKDYLKPDD$ | (SEQ ID NO: 1715) |
| *LSWAADVQAVVTDWVASGLDKDYLKPDD$ | (SEQ ID NO: 1716) |
| LSTAADMWAVVTDWVASGLDKDYLKPDD$ | (SEQ ID NO: 1717) |
| *LSTAADMWAVVTDWVASGLDKDYLKPDD$ | (SEQ ID NO: 1718) |
| LSWAADMWAVVTDWVASGLDKDYLKPDD$ | (SEQ ID NO: 1719) |
| *LSWAADMWAVVTDWVASGLDKDYLKPDD$ | (SEQ ID NO: 1720) |
| LSTAADLWAVVTDWVASGLDKDYLKPDD$ | (SEQ ID NO: 1721) |
| *LSTAADLWAVVTDWVASGLDKDYLKPDD$ | (SEQ ID NO: 1722) |
| LSWAADLWAVVTDWVASGLDKDYLKPDD$ | (SEQ ID NO: 1723) |
| *LSWAADLWAVVTDWVASGLDKDYLKPDD$ | (SEQ ID NO: 1724) |
| LSTAADVWAVVTDWVASGLDKDYLKPDD$ | (SEQ ID NO: 1725) |
| *LSTAADVWAVVTDWVASGLDKDYLKPDD$ | (SEQ ID NO: 1726) |
| LSWAADVWAVVTDWVASGLDKDYLKPDD$ | (SEQ ID NO: 1727) |
| *LSWAADVWAVVTDWVASGLDKDYLKPDD$ | (SEQ ID NO: 1728) |
| LSTAADMQGVVWDWVASGLDKDYLKPDD$ | (SEQ ID NO: 1729) |
| *LSTAADMQGVVWDWVASGLDKDYLKPDD$ | (SEQ ID NO: 1730) |
| LSWAADMQGVVWDWVASGLDKDYLKPDD$ | (SEQ ID NO: 1731) |
| *LSWAADMQGVVWDWVASGLDKDYLKPDD$ | (SEQ ID NO: 1732) |
| LSTAADLQGVVWDWVASGLDKDYLKPDD$ | (SEQ ID NO: 1733) |
| *LSTAADLQGVVWDWVASGLDKDYLKPDD$ | (SEQ ID NO: 1734) |
| LSWAADLQGVVWDWVASGLDKDYLKPDD$ | (SEQ ID NO: 1735) |
| *LSWAADLQGVVWDWVASGLDKDYLKPDD$ | (SEQ ID NO: 1736) |
| LSTAADVQGVVWDWVASGLDKDYLKPDD$ | (SEQ ID NO: 1737) |
| *LSTAADVQGVVWDWVASGLDKDYLKPDD$ | (SEQ ID NO: 1738) |
| LSWAADVQGVVWDWVASGLDKDYLKPDD$ | (SEQ ID NO: 1739) |
| *LSWAADVQGVVWDWVASGLDKDYLKPDD$ | (SEQ ID NO: 1740) |
| LSTAADMWGVVWDWVASGLDKDYLKPDD$ | (SEQ ID NO: 1741) |
| *LSTAADMWGVVWDWVASGLDKDYLKPDD$ | (SEQ ID NO: 1742) |
| LSWAADMWGVVWDWVASGLDKDYLKPDD$ | (SEQ ID NO: 1743) |
| *LSWAADMWGVVWDWVASGLDKDYLKPDD$ | (SEQ ID NO: 1744) |
| LSTAADLWGVVWDWVASGLDKDYLKPDD$ | (SEQ ID NO: 1745) |
| *LSTAADLWGVVWDWVASGLDKDYLKPDD$ | (SEQ ID NO: 1746) |

TABLE 3-continued

| Modified Curedoxin-Derived Peptides | |
|---|---|
| LSWAADLWGVVWDWVASGLDKDYLKPDD$ | (SEQ ID NO: 1747) |
| *LSWAADLWGVVWDWVASGLDKDYLKPDD$ | (SEQ ID NO: 1748) |
| LSTAADVWGVVWDWVASGLDKDYLKPDD$ | (SEQ ID NO: 1749) |
| *LSTAADVWGVVWDWVASGLDKDYLKPDD$ | (SEQ ID NO: 1750) |
| LSWAADVWGVVWDWVASGLDKDYLKPDD$ | (SEQ ID NO: 1751) |
| *LSWAADVWGVVWDWVASGLDKDYLKPDD$ | (SEQ ID NO: 1752) |
| LSTAADMQAVVWDWVASGLDKDYLKPDD$ | (SEQ ID NO: 1753) |
| *LSTAADMQAVVWDWVASGLDKDYLKPDD$ | (SEQ ID NO: 1754) |
| LSWAADMQAVVWDWVASGLDKDYLKPDD$ | (SEQ ID NO: 1755) |
| *LSWAADMQAVVWDWVASGLDKDYLKPDD$ | (SEQ ID NO: 1756) |
| LSTAADLQAVVWDWVASGLDKDYLKPDD$ | (SEQ ID NO: 1757) |
| *LSTAADLQAVVWDWVASGLDKDYLKPDD$ | (SEQ ID NO: 1758) |
| LSWAADLQAVVWDWVASGLDKDYLKPDD$ | (SEQ ID NO: 1759) |
| *LSWAADLQAVVWDWVASGLDKDYLKPDD$ | (SEQ ID NO: 1760) |
| LSTAADVQAVVWDWVASGLDKDYLKPDD$ | (SEQ ID NO: 1761) |
| *LSTAADVQAVVWDWVASGLDKDYLKPDD$ | (SEQ ID NO: 1762) |
| LSWAADVQAVVWDWVASGLDKDYLKPDD$ | (SEQ ID NO: 1763) |
| *LSWAADVQAVVWDWVASGLDKDYLKPDD$ | (SEQ ID NO: 1764) |
| LSTAADMWAVVWDWVASGLDKDYLKPDD$ | (SEQ ID NO: 1765) |
| *LSTAADMWAVVWDWVASGLDKDYLKPDD$ | (SEQ ID NO: 1766) |
| LSWAADMWAVVWDWVASGLDKDYLKPDD$ | (SEQ ID NO: 1767) |
| *LSWAADMWAVVWDWVASGLDKDYLKPDD$ | (SEQ ID NO: 1768) |
| LSTAADLWAVVWDWVASGLDKDYLKPDD$ | (SEQ ID NO: 1769) |
| *LSTAADLWAVVWDWVASGLDKDYLKPDD$ | (SEQ ID NO: 1770) |
| LSWAADLWAVVWDWVASGLDKDYLKPDD$ | (SEQ ID NO: 1771) |
| *LSWAADLWAVVWDWVASGLDKDYLKPDD$ | (SEQ ID NO: 1772) |
| LSTAADVWAVVWDWVASGLDKDYLKPDD$ | (SEQ ID NO: 1773) |
| *LSTAADVWAVVWDWVASGLDKDYLKPDD$ | (SEQ ID NO: 1774) |
| LSWAADVWAVVWDWVASGLDKDYLKPDD$ | (SEQ ID NO: 1775) |
| *LSWAADVWAVVWDWVASGLDKDYLKPDD$ | (SEQ ID NO: 1776) |
| *DDPKLYDKDLGSAVWDWVVAWVDAAWSL$ | (SEQ ID NO: 1777) |
| *DDPKLYDKDLGSAVWDWVVAWVDAAWSL | (SEQ ID NO: 1778) |
| *DDPKLYDKDLGSAVWDWVVAWVDAATSL$ | (SEQ ID NO: 1779) |
| *DDPKLYDKDLGSAVWDWVVAWVDAATSL | (SEQ ID NO: 1780) |
| *DDPKLYDKDLGSAVWDWVVAWLDAAWSL$ | (SEQ ID NO: 1781) |
| *DDPKLYDKDLGSAVWDWVVAWLDAAWSL | (SEQ ID NO: 1782) |
| *DDPKLYDKDLGSAVWDWVVAWLDAATSL$ | (SEQ ID NO: 1783) |
| *DDPKLYDKDLGSAVWDWVVAWLDAATSL | (SEQ ID NO: 1784) |
| *DDPKLYDKDLGSAVWDWVVAWMDAAWSL$ | (SEQ ID NO: 1785) |

TABLE 3-continued

| Modified Curedoxin-Derived Peptides | |
|---|---|
| *DDPKLYDKDLGSAVWDWVVAWMDAAWSL | (SEQ ID NO: 1786) |
| *DDPKLYDKDLGSAVWDWVVAWMDAATSL$ | (SEQ ID NO: 1787) |
| *DDPKLYDKDLGSAVWDWVVAWMDAATSL | (SEQ ID NO: 1788) |
| *DDPKLYDKDLGSAVWDWVVAQVDAAWSL$ | (SEQ ID NO: 1789) |
| *DDPKLYDKDLGSAVWDWVVAQVDAAWSL | (SEQ ID NO: 1790) |
| *DDPKLYDKDLGSAVWDWVVAQVDAATSL$ | (SEQ ID NO: 1791) |
| *DDPKLYDKDLGSAVWDWVVAQVDAATSL | (SEQ ID NO: 1792) |
| *DDPKLYDKDLGSAVWDWVVAQLDAAWSL$ | (SEQ ID NO: 1793) |
| *DDPKLYDKDLGSAVWDWVVAQLDAAWSL | (SEQ ID NO: 1794) |
| *DDPKLYDKDLGSAVWDWVVAQLDAATSL$ | (SEQ ID NO: 1795) |
| *DDPKLYDKDLGSAVWDWVVAQLDAATSL | (SEQ ID NO: 1796) |
| *DDPKLYDKDLGSAVWDWVVAQMDAAWSL$ | (SEQ ID NO: 1797) |
| *DDPKLYDKDLGSAVWDWVVAQMDAAWSL | (SEQ ID NO: 1798) |
| *DDPKLYDKDLGSAVWDWVVAQMDAATSL$ | (SEQ ID NO: 1799) |
| *DDPKLYDKDLGSAVWDWVVAQMDAATSL | (SEQ ID NO: 1800) |
| *DDPKLYDKDLGSAVWDWVVGWVDAAWSL$ | (SEQ ID NO: 1801) |
| *DDPKLYDKDLGSAVWDWVVGWVDAAWSL | (SEQ ID NO: 1802) |
| *DDPKLYDKDLGSAVWDWVVGWVDAATSL$ | (SEQ ID NO: 1803) |
| *DDPKLYDKDLGSAVWDWVVGWVDAATSL | (SEQ ID NO: 1804) |
| *DDPKLYDKDLGSAVWDWVVGWLDAAWSL$ | (SEQ ID NO: 1805) |
| *DDPKLYDKDLGSAVWDWVVGWLDAAWSL | (SEQ ID NO: 1806) |
| *DDPKLYDKDLGSAVWDWVVGWLDAATSL$ | (SEQ ID NO: 1807) |
| *DDPKLYDKDLGSAVWDWVVGWLDAATSL | (SEQ ID NO: 1808) |
| *DDPKLYDKDLGSAVWDWVVGWMDAAWSL$ | (SEQ ID NO: 1809) |
| *DDPKLYDKDLGSAVWDWVVGWMDAAWSL | (SEQ ID NO: 1810) |
| *DDPKLYDKDLGSAVWDWVVGWMDAATSL$ | (SEQ ID NO: 1811) |
| *DDPKLYDKDLGSAVWDWVVGWMDAATSL | (SEQ ID NO: 1812) |
| *DDPKLYDKDLGSAVWDWVVGQVDAAWSL$ | (SEQ ID NO: 1813) |
| *DDPKLYDKDLGSAVWDWVVGQVDAAWSL | (SEQ ID NO: 1814) |
| *DDPKLYDKDLGSAVWDWVVGQVDAATSL$ | (SEQ ID NO: 1815) |
| *DDPKLYDKDLGSAVWDWVVGQVDAATSL | (SEQ ID NO: 1816) |
| *DDPKLYDKDLGSAVWDWVVGQLDAAWSL$ | (SEQ ID NO: 1817) |
| *DDPKLYDKDLGSAVWDWVVGQLDAAWSL | (SEQ ID NO: 1818) |
| *DDPKLYDKDLGSAVWDWVVGQLDAATSL$ | (SEQ ID NO: 1819) |
| *DDPKLYDKDLGSAVWDWVVGQLDAATSL | (SEQ ID NO: 1820) |
| *DDPKLYDKDLGSAVWDWVVGQMDAAWSL$ | (SEQ ID NO: 1821) |
| *DDPKLYDKDLGSAVWDWVVGQMDAAWSL | (SEQ ID NO: 1822) |
| *DDPKLYDKDLGSAVWDWVVGQMDAATSL$ | (SEQ ID NO: 1823) |
| *DDPKLYDKDLGSAVWDWVVGQMDAATSL | (SEQ ID NO: 1824) |

TABLE 3-continued

| Modified Curedoxin-Derived Peptides | |
| --- | --- |
| *DDPKLYDKDLGSAVWDTVVAWVDAAWSL$ | (SEQ ID NO: 1825) |
| *DDPKLYDKDLGSAVWDTVVAWVDAAWSL | (SEQ ID NO: 1826) |
| *DDPKLYDKDLGSAVWDTVVAWVDAATSL$ | (SEQ ID NO: 1827) |
| *DDPKLYDKDLGSAVWDTVVAWVDAATSL | (SEQ ID NO: 1828) |
| *DDPKLYDKDLGSAVWDTVVAWLDAAWSL$ | (SEQ ID NO: 1829) |
| *DDPKLYDKDLGSAVWDTVVAWLDAAWSL | (SEQ ID NO: 1830) |
| *DDPKLYDKDLGSAVWDTVVAWLDAATSL$ | (SEQ ID NO: 1831) |
| *DDPKLYDKDLGSAVWDTVVAWLDAATSL | (SEQ ID NO: 1832) |
| *DDPKLYDKDLGSAVWDTVVAWMDAAWSL$ | (SEQ ID NO: 1833) |
| *DDPKLYDKDLGSAVWDTVVAWMDAAWSL | (SEQ ID NO: 1834) |
| *DDPKLYDKDLGSAVWDTVVAWMDAATSL$ | (SEQ ID NO: 1835) |
| *DDPKLYDKDLGSAVWDTVVAWMDAATSL | (SEQ ID NO: 1836) |
| *DDPKLYDKDLGSAVWDTVVAQVDAAWSL$ | (SEQ ID NO: 1837) |
| *DDPKLYDKDLGSAVWDTVVAQVDAAWSL | (SEQ ID NO: 1838) |
| *DDPKLYDKDLGSAVWDTVVAQVDAATSL$ | (SEQ ID NO: 1839) |
| *DDPKLYDKDLGSAVWDTVVAQVDAATSL | (SEQ ID NO: 1840) |
| *DDPKLYDKDLGSAVWDTVVAQLDAAWSL$ | (SEQ ID NO: 1841) |
| *DDPKLYDKDLGSAVWDTVVAQLDAAWSL | (SEQ ID NO: 1842) |
| *DDPKLYDKDLGSAVWDTVVAQLDAATSL$ | (SEQ ID NO: 1843) |
| *DDPKLYDKDLGSAVWDTVVAQLDAATSL | (SEQ ID NO: 1844) |
| *DDPKLYDKDLGSAVWDTVVAQMDAAWSL$ | (SEQ ID NO: 1845) |
| *DDPKLYDKDLGSAVWDTVVAQMDAAWSL | (SEQ ID NO: 1846) |
| *DDPKLYDKDLGSAVWDTVVAQMDAATSL$ | (SEQ ID NO: 1847) |
| *DDPKLYDKDLGSAVWDTVVAQMDAATSL | (SEQ ID NO: 1848) |
| *DDPKLYDKDLGSAVWDTVVGWVDAAWSL$ | (SEQ ID NO: 1849) |
| *DDPKLYDKDLGSAVWDTVVGWVDAAWSL | (SEQ ID NO: 1850) |
| *DDPKLYDKDLGSAVWDTVVGWVDAATSL$ | (SEQ ID NO: 1851) |
| *DDPKLYDKDLGSAVWDTVVGWVDAATSL | (SEQ ID NO: 1852) |
| *DDPKLYDKDLGSAVWDTVVGWLDAAWSL$ | (SEQ ID NO: 1853) |
| *DDPKLYDKDLGSAVWDTVVGWLDAAWSL | (SEQ ID NO: 1854) |
| *DDPKLYDKDLGSAVWDTVVGWLDAATSL$ | (SEQ ID NO: 1855) |
| *DDPKLYDKDLGSAVWDTVVGWLDAATSL | (SEQ ID NO: 1856) |
| *DDPKLYDKDLGSAVWDTVVGWMDAAWSL$ | (SEQ ID NO: 1857) |
| *DDPKLYDKDLGSAVWDTVVGWMDAAWSL | (SEQ ID NO: 1858) |
| *DDPKLYDKDLGSAVWDTVVGWMDAATSL$ | (SEQ ID NO: 1859) |
| *DDPKLYDKDLGSAVWDTVVGWMDAATSL | (SEQ ID NO: 1860) |
| *DDPKLYDKDLGSAVWDTVVGQVDAAWSL$ | (SEQ ID NO: 1861) |
| *DDPKLYDKDLGSAVWDTVVGQVDAAWSL | (SEQ ID NO: 1862) |
| *DDPKLYDKDLGSAVWDTVVGQVDAATSL$ | (SEQ ID NO: 1863) |

TABLE 3-continued

| Modified Curedoxin-Derived Peptides | |
| --- | --- |
| *DDPKLYDKDLGSAVWDTVVGQVDAATSL | (SEQ ID NO: 1864) |
| *DDPKLYDKDLGSAVWDTVVGQLDAAWSL$ | (SEQ ID NO: 1865) |
| *DDPKLYDKDLGSAVWDTVVGQLDAAWSL | (SEQ ID NO: 1866) |
| *DDPKLYDKDLGSAVWDTVVGQLDAATSL$ | (SEQ ID NO: 1867) |
| *DDPKLYDKDLGSAVWDTVVGQLDAATSL | (SEQ ID NO: 1868) |
| *DDPKLYDKDLGSAVWDTVVGQMDAAWSL$ | (SEQ ID NO: 1869) |
| *DDPKLYDKDLGSAVWDTVVGQMDAAWSL | (SEQ ID NO: 1870) |
| *DDPKLYDKDLGSAVWDTVVGQMDAATSL$ | (SEQ ID NO: 1871) |
| *DDPKLYDKDLGSAVWDTVVGQMDAATSL | (SEQ ID NO: 1872) |
| *DDPKLYDKDLGSAVTDWVVAWVDAAWSL$ | (SEQ ID NO: 1873) |
| *DDPKLYDKDLGSAVTDWVVAWVDAAWSL | (SEQ ID NO: 1874) |
| *DDPKLYDKDLGSAVTDWVVAWVDAATSL$ | (SEQ ID NO: 1875) |
| *DDPKLYDKDLGSAVTDWVVAWVDAATSL | (SEQ ID NO: 1876) |
| *DDPKLYDKDLGSAVTDWVVAWLDAAWSL$ | (SEQ ID NO: 1877) |
| *DDPKLYDKDLGSAVTDWVVAWLDAAWSL | (SEQ ID NO: 1878) |
| *DDPKLYDKDLGSAVTDWVVAWLDAATSL$ | (SEQ ID NO: 1879) |
| *DDPKLYDKDLGSAVTDWVVAWLDAATSL | (SEQ ID NO: 1880) |
| *DDPKLYDKDLGSAVTDWVVAWMDAAWSL$ | (SEQ ID NO: 1881) |
| *DDPKLYDKDLGSAVTDWVVAWMDAAWSL | (SEQ ID NO: 1882) |
| *DDPKLYDKDLGSAVTDWVVAWMDAATSL$ | (SEQ ID NO: 1883) |
| *DDPKLYDKDLGSAVTDWVVAWMDAATSL | (SEQ ID NO: 1884) |
| *DDPKLYDKDLGSAVTDWVVAQVDAAWSL$ | (SEQ ID NO: 1885) |
| *DDPKLYDKDLGSAVTDWVVAQVDAAWSL | (SEQ ID NO: 1886) |
| *DDPKLYDKDLGSAVTDWVVAQVDAATSL$ | (SEQ ID NO: 1887) |
| *DDPKLYDKDLGSAVTDWVVAQVDAATSL | (SEQ ID NO: 1888) |
| *DDPKLYDKDLGSAVTDWVVAQLDAAWSL$ | (SEQ ID NO: 1889) |
| *DDPKLYDKDLGSAVTDWVVAQLDAAWSL | (SEQ ID NO: 1890) |
| *DDPKLYDKDLGSAVTDWVVAQLDAATSL$ | (SEQ ID NO: 1891) |
| *DDPKLYDKDLGSAVTDWVVAQLDAATSL | (SEQ ID NO: 1892) |
| *DDPKLYDKDLGSAVTDWVVAQMDAAWSL$ | (SEQ ID NO: 1893) |
| *DDPKLYDKDLGSAVTDWVVAQMDAAWSL | (SEQ ID NO: 1894) |
| *DDPKLYDKDLGSAVTDWVVAQMDAATSL$ | (SEQ ID NO: 1895) |
| *DDPKLYDKDLGSAVTDWVVAQMDAATSL | (SEQ ID NO: 1896) |
| *DDPKLYDKDLGSAVTDWVVGWVDAAWSL$ | (SEQ ID NO: 1897) |
| *DDPKLYDKDLGSAVTDWVVGWVDAAWSL | (SEQ ID NO: 1898) |
| *DDPKLYDKDLGSAVTDWVVGWVDAATSL$ | (SEQ ID NO: 1899) |
| *DDPKLYDKDLGSAVTDWVVGWVDAATSL | (SEQ ID NO: 1900) |
| *DDPKLYDKDLGSAVTDWVVGWLDAAWSL$ | (SEQ ID NO: 1901) |
| *DDPKLYDKDLGSAVTDWVVGWLDAAWSL | (SEQ ID NO: 1902) |

TABLE 3-continued

| Modified Curedoxin-Derived Peptides | |
|---|---|
| *DDPKLYDKDLGSAVTDWVVGWLDAATSL$ | (SEQ ID NO: 1903) |
| *DDPKLYDKDLGSAVTDWVVGWLDAATSL | (SEQ ID NO: 1904) |
| *DDPKLYDKDLGSAVTDWVVGWMDAAWSL$ | (SEQ ID NO: 1905) |
| *DDPKLYDKDLGSAVTDWVVGWMDAAWSL | (SEQ ID NO: 1906) |
| *DDPKLYDKDLGSAVTDWVVGWMDAATSL$ | (SEQ ID NO: 1907) |
| *DDPKLYDKDLGSAVTDWVVGWMDAATSL | (SEQ ID NO: 1908) |
| *DDPKLYDKDLGSAVTDWVVGQVDAAWSL$ | (SEQ ID NO: 1909) |
| *DDPKLYDKDLGSAVTDWVVGQVDAAWSL | (SEQ ID NO: 1910) |
| *DDPKLYDKDLGSAVTDWVVGQVDAATSL$ | (SEQ ID NO: 1911) |
| *DDPKLYDKDLGSAVTDWVVGQVDAATSL | (SEQ ID NO: 1912) |
| *DDPKLYDKDLGSAVTDWVVGQLDAAWSL$ | (SEQ ID NO: 1913) |
| *DDPKLYDKDLGSAVTDWVVGQLDAAWSL | (SEQ ID NO: 1914) |
| *DDPKLYDKDLGSAVTDWVVGQLDAATSL$ | (SEQ ID NO: 1915) |
| *DDPKLYDKDLGSAVTDWVVGQLDAATSL | (SEQ ID NO: 1916) |
| *DDPKLYDKDLGSAVTDWVVGQMDAAWSL$ | (SEQ ID NO: 1917) |
| *DDPKLYDKDLGSAVTDWVVGQMDAAWSL | (SEQ ID NO: 1918) |
| *DDPKLYDKDLGSAVTDWVVGQMDAATSL$ | (SEQ ID NO: 1919) |
| *DDPKLYDKDLGSAVTDWVVGQMDAATSL | (SEQ ID NO: 1920) |
| *DDPKLYDKDLGSAVTDTVVAWVDAAWSL$ | (SEQ ID NO: 1921) |
| *DDPKLYDKDLGSAVTDTVVAWVDAAWSL | (SEQ ID NO: 1922) |
| *DDPKLYDKDLGSAVTDTVVAWVDAATSL$ | (SEQ ID NO: 1923) |
| *DDPKLYDKDLGSAVTDTVVAWVDAATSL | (SEQ ID NO: 1924) |
| *DDPKLYDKDLGSAVTDTVVAWLDAAWSL$ | (SEQ ID NO: 1925) |
| *DDPKLYDKDLGSAVTDTVVAWLDAAWSL | (SEQ ID NO: 1926) |
| *DDPKLYDKDLGSAVTDTVVAWLDAATSL$ | (SEQ ID NO: 1927) |
| *DDPKLYDKDLGSAVTDTVVAWLDAATSL | (SEQ ID NO: 1928) |
| *DDPKLYDKDLGSAVTDTVVAWMDAAWSL$ | (SEQ ID NO: 1929) |
| *DDPKLYDKDLGSAVTDTVVAWMDAAWSL | (SEQ ID NO: 1930) |
| *DDPKLYDKDLGSAVTDTVVAWMDAATSL$ | (SEQ ID NO: 1931) |
| *DDPKLYDKDLGSAVTDTVVAWMDAATSL | (SEQ ID NO: 1932) |
| *DDPKLYDKDLGSAVTDTVVAQVDAAWSL$ | (SEQ ID NO: 1933) |
| *DDPKLYDKDLGSAVTDTVVAQVDAAWSL | (SEQ ID NO: 1934) |
| *DDPKLYDKDLGSAVTDTVVAQVDAATSL$ | (SEQ ID NO: 1935) |
| *DDPKLYDKDLGSAVTDTVVAQVDAATSL | (SEQ ID NO: 1936) |
| *DDPKLYDKDLGSAVTDTVVAQLDAAWSL$ | (SEQ ID NO: 1937) |
| *DDPKLYDKDLGSAVTDTVVAQLDAAWSL | (SEQ ID NO: 1938) |
| *DDPKLYDKDLGSAVTDTVVAQLDAATSL$ | (SEQ ID NO: 1939) |
| *DDPKLYDKDLGSAVTDTVVAQLDAATSL | (SEQ ID NO: 1940) |
| *DDPKLYDKDLGSAVTDTVVAQMDAAWSL$ | (SEQ ID NO: 1941) |

TABLE 3-continued

| Modified Curedoxin-Derived Peptides | |
|---|---|
| *DDPKLYDKDLGSAVTDTVVAQMDAAWSL | (SEQ ID NO: 1942) |
| *DDPKLYDKDLGSAVTDTVVAQMDAATSL$ | (SEQ ID NO: 1943) |
| *DDPKLYDKDLGSAVTDTVVAQMDAATSL | (SEQ ID NO: 1944) |
| *DDPKLYDKDLGSAVTDTVVGWVDAAWSL$ | (SEQ ID NO: 1945) |
| *DDPKLYDKDLGSAVTDTVVGWVDAAWSL | (SEQ ID NO: 1946) |
| *DDPKLYDKDLGSAVTDTVVGWVDAATSL$ | (SEQ ID NO: 1947) |
| *DDPKLYDKDLGSAVTDTVVGWVDAATSL | (SEQ ID NO: 1948) |
| *DDPKLYDKDLGSAVTDTVVGWLDAAWSL$ | (SEQ ID NO: 1949) |
| *DDPKLYDKDLGSAVTDTVVGWLDAAWSL | (SEQ ID NO: 1950) |
| *DDPKLYDKDLGSAVTDTVVGWLDAATSL$ | (SEQ ID NO: 1951) |
| *DDPKLYDKDLGSAVTDTVVGWLDAATSL | (SEQ ID NO: 1952) |
| *DDPKLYDKDLGSAVTDTVVGWMDAAWSL$ | (SEQ ID NO: 1953) |
| *DDPKLYDKDLGSAVTDTVVGWMDAAWSL | (SEQ ID NO: 1954) |
| *DDPKLYDKDLGSAVTDTVVGWMDAATSL$ | (SEQ ID NO: 1955) |
| *DDPKLYDKDLGSAVTDTVVGWMDAATSL | (SEQ ID NO: 1956) |
| *DDPKLYDKDLGSAVTDTVVGQVDAAWSL$ | (SEQ ID NO: 1957) |
| *DDPKLYDKDLGSAVTDTVVGQVDAAWSL | (SEQ ID NO: 1958) |
| *DDPKLYDKDLGSAVTDTVVGQVDAATSL$ | (SEQ ID NO: 1959) |
| *DDPKLYDKDLGSAVTDTVVGQVDAATSL | (SEQ ID NO: 1960) |
| *DDPKLYDKDLGSAVTDTVVGQLDAAWSL$ | (SEQ ID NO: 1961) |
| *DDPKLYDKDLGSAVTDTVVGQLDAAWSL | (SEQ ID NO: 1962) |
| *DDPKLYDKDLGSAVTDTVVGQLDAATSL$ | (SEQ ID NO: 1963) |
| *DDPKLYDKDLGSAVTDTVVGQLDAATSL | (SEQ ID NO: 1964) |
| *DDPKLYDKDLGSAVTDTVVGQMDAAWSL$ | (SEQ ID NO: 1965) |
| *DDPKLYDKDLGSAVTDTVVGQMDAAWSL | (SEQ ID NO: 1966) |
| *DDPKLYDKDLGSAVTDTVVGQMDAATSL$ | (SEQ ID NO: 1967) |
| *DDPKLYDKDLGSAVTDTVVGQMDAATSL | (SEQ ID NO: 1968) |
| *DDPKLYDKDLGSAVGDWVVAWVDAAWSL$ | (SEQ ID NO: 1969) |
| *DDPKLYDKDLGSAVGDWVVAWVDAAWSL | (SEQ ID NO: 1970) |
| *DDPKLYDKDLGSAVGDWVVAWVDAATSL$ | (SEQ ID NO: 1971) |
| *DDPKLYDKDLGSAVGDWVVAWVDAATSL | (SEQ ID NO: 1972) |
| *DDPKLYDKDLGSAVGDWVVAWLDAAWSL$ | (SEQ ID NO: 1973) |
| *DDPKLYDKDLGSAVGDWVVAWLDAAWSL | (SEQ ID NO: 1974) |
| *DDPKLYDKDLGSAVGDWVVAWLDAATSL$ | (SEQ ID NO: 1975) |
| *DDPKLYDKDLGSAVGDWVVAWLDAATSL | (SEQ ID NO: 1976) |
| *DDPKLYDKDLGSAVGDWVVAWMDAAWSL$ | (SEQ ID NO: 1977) |
| *DDPKLYDKDLGSAVGDWVVAWMDAAWSL | (SEQ ID NO: 1978) |
| *DDPKLYDKDLGSAVGDWVVAWMDAATSL$ | (SEQ ID NO: 1979) |
| *DDPKLYDKDLGSAVGDWVVAWMDAATSL | (SEQ ID NO: 1980) |

TABLE 3-continued

| Modified Curedoxin-Derived Peptides | |
|---|---|
| *DDPKLYDKDLGSAVGDWVVAQVDAAWSL$ | (SEQ ID NO: 1981) |
| *DDPKLYDKDLGSAVGDWVVAQVDAAWSL | (SEQ ID NO: 1982) |
| *DDPKLYDKDLGSAVGDWVVAQVDAATSL$ | (SEQ ID NO: 1983) |
| *DDPKLYDKDLGSAVGDWVVAQVDAATSL | (SEQ ID NO: 1984) |
| *DDPKLYDKDLGSAVGDWVVAQLDAAWSL$ | (SEQ ID NO: 1985) |
| *DDPKLYDKDLGSAVGDWVVAQLDAAWSL | (SEQ ID NO: 1986) |
| *DDPKLYDKDLGSAVGDWVVAQLDAATSL$ | (SEQ ID NO: 1987) |
| *DDPKLYDKDLGSAVGDWVVAQLDAATSL | (SEQ ID NO: 1988) |
| *DDPKLYDKDLGSAVGDWVVAQMDAAWSL$ | (SEQ ID NO: 1989) |
| *DDPKLYDKDLGSAVGDWVVAQMDAAWSL | (SEQ ID NO: 1990) |
| *DDPKLYDKDLGSAVGDWVVAQMDAATSL$ | (SEQ ID NO: 1991) |
| *DDPKLYDKDLGSAVGDWVVAQMDAATSL | (SEQ ID NO: 1992) |
| *DDPKLYDKDLGSAVGDWVVGWVDAAWSL$ | (SEQ ID NO: 1993) |
| *DDPKLYDKDLGSAVGDWVVGWVDAAWSL | (SEQ ID NO: 1994) |
| *DDPKLYDKDLGSAVGDWVVGWVDAATSL$ | (SEQ ID NO: 1995) |
| *DDPKLYDKDLGSAVGDWVVGWVDAATSL | (SEQ ID NO: 1996) |
| *DDPKLYDKDLGSAVGDWVVGWLDAAWSL$ | (SEQ ID NO: 1997) |
| *DDPKLYDKDLGSAVGDWVVGWLDAAWSL | (SEQ ID NO: 1998) |
| *DDPKLYDKDLGSAVGDWVVGWLDAATSL$ | (SEQ ID NO: 1999) |
| *DDPKLYDKDLGSAVGDWVVGWLDAATSL | (SEQ ID NO: 2000) |
| *DDPKLYDKDLGSAVGDWVVGWMDAAWSL$ | (SEQ ID NO: 2001) |
| *DDPKLYDKDLGSAVGDWVVGWMDAAWSL | (SEQ ID NO: 2002) |
| *DDPKLYDKDLGSAVGDWVVGWMDAATSL$ | (SEQ ID NO: 2003) |
| *DDPKLYDKDLGSAVGDWVVGWMDAATSL | (SEQ ID NO: 2004) |
| *DDPKLYDKDLGSAVGDWVVGQVDAAWSL$ | (SEQ ID NO: 2005) |
| *DDPKLYDKDLGSAVGDWVVGQVDAAWSL | (SEQ ID NO: 2006) |
| *DDPKLYDKDLGSAVGDWVVGQVDAATSL$ | (SEQ ID NO: 2007) |
| *DDPKLYDKDLGSAVGDWVVGQVDAATSL | (SEQ ID NO: 2008) |
| *DDPKLYDKDLGSAVGDWVVGQLDAAWSL$ | (SEQ ID NO: 2009) |
| *DDPKLYDKDLGSAVGDWVVGQLDAAWSL | (SEQ ID NO: 2010) |
| *DDPKLYDKDLGSAVGDWVVGQLDAATSL$ | (SEQ ID NO: 2011) |
| *DDPKLYDKDLGSAVGDWVVGQLDAATSL | (SEQ ID NO: 2012) |
| *DDPKLYDKDLGSAVGDWVVGQMDAAWSL$ | (SEQ ID NO: 2013) |
| *DDPKLYDKDLGSAVGDWVVGQMDAAWSL | (SEQ ID NO: 2014) |
| *DDPKLYDKDLGSAVGDWVVGQMDAATSL$ | (SEQ ID NO: 2015) |
| *DDPKLYDKDLGSAVGDWVVGQMDAATSL | (SEQ ID NO: 2016) |
| *DDPKLYDKDLGSAVGDTVVAWVDAAWSL$ | (SEQ ID NO: 2017) |
| *DDPKLYDKDLGSAVGDTVVAWVDAAWSL | (SEQ ID NO: 2018) |
| *DDPKLYDKDLGSAVGDTVVAWVDAATSL$ | (SEQ ID NO: 2019) |

TABLE 3-continued

| Modified Curedoxin-Derived Peptides | |
|---|---|
| *DDPKLYDKDLGSAVGDTVVAWVDAATSL | (SEQ ID NO: 2020) |
| *DDPKLYDKDLGSAVGDTVVAWLDAAWSL$ | (SEQ ID NO: 2021) |
| *DDPKLYDKDLGSAVGDTVVAWLDAAWSL | (SEQ ID NO: 2022) |
| *DDPKLYDKDLGSAVGDTVVAWLDAATSL$ | (SEQ ID NO: 2023) |
| *DDPKLYDKDLGSAVGDTVVAWLDAATSL | (SEQ ID NO: 2024) |
| *DDPKLYDKDLGSAVGDTVVAWMDAAWSL$ | (SEQ ID NO: 2025) |
| *DDPKLYDKDLGSAVGDTVVAWMDAAWSL | (SEQ ID NO: 2026) |
| *DDPKLYDKDLGSAVGDTVVAWMDAATSL$ | (SEQ ID NO: 2027) |
| *DDPKLYDKDLGSAVGDTVVAWMDAATSL | (SEQ ID NO: 2028) |
| *DDPKLYDKDLGSAVGDTVVAQVDAAWSL$ | (SEQ ID NO: 2029) |
| *DDPKLYDKDLGSAVGDTVVAQVDAAWSL | (SEQ ID NO: 2030) |
| *DDPKLYDKDLGSAVGDTVVAQVDAATSL$ | (SEQ ID NO: 2031) |
| *DDPKLYDKDLGSAVGDTVVAQVDAATSL | (SEQ ID NO: 2032) |
| *DDPKLYDKDLGSAVGDTVVAQLDAAWSL$ | (SEQ ID NO: 2033) |
| *DDPKLYDKDLGSAVGDTVVAQLDAAWSL | (SEQ ID NO: 2034) |
| *DDPKLYDKDLGSAVGDTVVAQLDAATSL$ | (SEQ ID NO: 2035) |
| *DDPKLYDKDLGSAVGDTVVAQLDAATSL | (SEQ ID NO: 2036) |
| *DDPKLYDKDLGSAVGDTVVAQMDAAWSL$ | (SEQ ID NO: 2037) |
| *DDPKLYDKDLGSAVGDTVVAQMDAAWSL | (SEQ ID NO: 2038) |
| *DDPKLYDKDLGSAVGDTVVAQMDAATSL$ | (SEQ ID NO: 2039) |
| *DDPKLYDKDLGSAVGDTVVAQMDAATSL | (SEQ ID NO: 2040) |
| *DDPKLYDKDLGSAVGDTVVGWVDAAWSL$ | (SEQ ID NO: 2041) |
| *DDPKLYDKDLGSAVGDTVVGWVDAAWSL | (SEQ ID NO: 2042) |
| *DDPKLYDKDLGSAVGDTVVGWVDAATSL$ | (SEQ ID NO: 2043) |
| *DDPKLYDKDLGSAVGDTVVGWVDAATSL | (SEQ ID NO: 2044) |
| *DDPKLYDKDLGSAVGDTVVGWLDAAWSL$ | (SEQ ID NO: 2045) |
| *DDPKLYDKDLGSAVGDTVVGWLDAAWSL | (SEQ ID NO: 2046) |
| *DDPKLYDKDLGSAVGDTVVGWLDAATSL$ | (SEQ ID NO: 2047) |
| *DDPKLYDKDLGSAVGDTVVGWLDAATSL | (SEQ ID NO: 2048) |
| *DDPKLYDKDLGSAVGDTVVGWMDAAWSL$ | (SEQ ID NO: 2049) |
| *DDPKLYDKDLGSAVGDTVVGWMDAAWSL | (SEQ ID NO: 2050) |
| *DDPKLYDKDLGSAVGDTVVGWMDAATSL$ | (SEQ ID NO: 2051) |
| *DDPKLYDKDLGSAVGDTVVGWMDAATSL | (SEQ ID NO: 2052) |
| *DDPKLYDKDLGSAVGDTVVGQVDAAWSL$ | (SEQ ID NO: 2053) |
| *DDPKLYDKDLGSAVGDTVVGQVDAAWSL | (SEQ ID NO: 2054) |
| *DDPKLYDKDLGSAVGDTVVGQVDAATSL$ | (SEQ ID NO: 2055) |
| *DDPKLYDKDLGSAVGDTVVGQVDAATSL | (SEQ ID NO: 2056) |
| *DDPKLYDKDLGSAVGDTVVGQLDAAWSL$ | (SEQ ID NO: 2057) |
| *DDPKLYDKDLGSAVGDTVVGQLDAAWSL | (SEQ ID NO: 2058) |

TABLE 3-continued

| Modified Curedoxin-Derived Peptides | |
|---|---|
| *DDPKLYDKDLGSAVGDTVVGQLDAATSL$ | (SEQ ID NO: 2059) |
| *DDPKLYDKDLGSAVGDTVVGQLDAATSL | (SEQ ID NO: 2060) |
| *DDPKLYDKDLGSAVGDTVVGQMDAAWSL$ | (SEQ ID NO: 2061) |
| *DDPKLYDKDLGSAVGDTVVGQMDAAWSL | (SEQ ID NO: 2062) |
| *DDPKLYDKDLGSAVGDTVVGQMDAATSL$ | (SEQ ID NO: 2063) |
| *DDPKLYDKDLGSAVGDTVVGQMDAATSL | (SEQ ID NO: 2064) |
| *DDPKLYDKDLGSALWDWVVAWVDAAWSL$ | (SEQ ID NO: 2065) |
| *DDPKLYDKDLGSALWDWVVAWVDAAWSL | (SEQ ID NO: 2066) |
| *DDPKLYDKDLGSALWDWVVAWVDAATSL$ | (SEQ ID NO: 2067) |
| *DDPKLYDKDLGSALWDWVVAWVDAATSL | (SEQ ID NO: 2068) |
| *DDPKLYDKDLGSALWDWVVAWLDAAWSL$ | (SEQ ID NO: 2069) |
| *DDPKLYDKDLGSALWDWVVAWLDAAWSL | (SEQ ID NO: 2070) |
| *DDPKLYDKDLGSALWDWVVAWLDAATSL$ | (SEQ ID NO: 2071) |
| *DDPKLYDKDLGSALWDWVVAWLDAATSL | (SEQ ID NO: 2072) |
| *DDPKLYDKDLGSALWDWVVAWMDAAWSL$ | (SEQ ID NO: 2073) |
| *DDPKLYDKDLGSALWDWVVAWMDAAWSL | (SEQ ID NO: 2074) |
| *DDPKLYDKDLGSALWDWVVAWMDAATSL$ | (SEQ ID NO: 2075) |
| *DDPKLYDKDLGSALWDWVVAWMDAATSL | (SEQ ID NO: 2076) |
| *DDPKLYDKDLGSALWDWVVAQVDAAWSL$ | (SEQ ID NO: 2077) |
| *DDPKLYDKDLGSALWDWVVAQVDAAWSL | (SEQ ID NO: 2078) |
| *DDPKLYDKDLGSALWDWVVAQVDAATSL$ | (SEQ ID NO: 2079) |
| *DDPKLYDKDLGSALWDWVVAQVDAATSL | (SEQ ID NO: 2080) |
| *DDPKLYDKDLGSALWDWVVAQLDAAWSL$ | (SEQ ID NO: 2081) |
| *DDPKLYDKDLGSALWDWVVAQLDAAWSL | (SEQ ID NO: 2082) |
| *DDPKLYDKDLGSALWDWVVAQLDAATSL$ | (SEQ ID NO: 2083) |
| *DDPKLYDKDLGSALWDWVVAQLDAATSL | (SEQ ID NO: 2084) |
| *DDPKLYDKDLGSALWDWVVAQMDAAWSL$ | (SEQ ID NO: 2085) |
| *DDPKLYDKDLGSALWDWVVAQMDAAWSL | (SEQ ID NO: 2086) |
| *DDPKLYDKDLGSALWDWVVAQMDAATSL$ | (SEQ ID NO: 2087) |
| *DDPKLYDKDLGSALWDWVVAQMDAATSL | (SEQ ID NO: 2088) |
| *DDPKLYDKDLGSALWDWVVGWVDAAWSL$ | (SEQ ID NO: 2089) |
| *DDPKLYDKDLGSALWDWVVGWVDAAWSL | (SEQ ID NO: 2090) |
| *DDPKLYDKDLGSALWDWVVGWVDAATSL$ | (SEQ ID NO: 2091) |
| *DDPKLYDKDLGSALWDWVVGWVDAATSL | (SEQ ID NO: 2092) |
| *DDPKLYDKDLGSALWDWVVGWLDAAWSL$ | (SEQ ID NO: 2093) |
| *DDPKLYDKDLGSALWDWVVGWLDAAWSL | (SEQ ID NO: 2094) |
| *DDPKLYDKDLGSALWDWVVGWLDAATSL$ | (SEQ ID NO: 2095) |
| *DDPKLYDKDLGSALWDWVVGWLDAATSL | (SEQ ID NO: 2096) |
| *DDPKLYDKDLGSALWDWVVGWMDAAWSL$ | (SEQ ID NO: 2097) |

TABLE 3-continued

| Modified Curedoxin-Derived Peptides | |
|---|---|
| *DDPKLYDKDLGSALWDWVVGWMDAAWSL | (SEQ ID NO: 2098) |
| *DDPKLYDKDLGSALWDWVVGWMDAATSL$ | (SEQ ID NO: 2099) |
| *DDPKLYDKDLGSALWDWVVGWMDAATSL | (SEQ ID NO: 2100) |
| *DDPKLYDKDLGSALWDWVVGQVDAAWSL$ | (SEQ ID NO: 2101) |
| *DDPKLYDKDLGSALWDWVVGQVDAAWSL | (SEQ ID NO: 2102) |
| *DDPKLYDKDLGSALWDWVVGQVDAATSL$ | (SEQ ID NO: 2103) |
| *DDPKLYDKDLGSALWDWVVGQVDAATSL | (SEQ ID NO: 2104) |
| *DDPKLYDKDLGSALWDWVVGQLDAAWSL$ | (SEQ ID NO: 2105) |
| *DDPKLYDKDLGSALWDWVVGQLDAAWSL | (SEQ ID NO: 2106) |
| *DDPKLYDKDLGSALWDWVVGQLDAATSL$ | (SEQ ID NO: 2107) |
| *DDPKLYDKDLGSALWDWVVGQLDAATSL | (SEQ ID NO: 2108) |
| *DDPKLYDKDLGSALWDWVVGQMDAAWSL$ | (SEQ ID NO: 2109) |
| *DDPKLYDKDLGSALWDWVVGQMDAAWSL$ | (SEQ ID NO: 2110) |
| *DDPKLYDKDLGSALWDWVVGQMDAATSL$ | (SEQ ID NO: 2111) |
| *DDPKLYDKDLGSALWDWVVGQMDAATSL | (SEQ ID NO: 2112) |
| *DDPKLYDKDLGSALWDTVVAWVDAAWSL$ | (SEQ ID NO: 2113) |
| *DDPKLYDKDLGSALWDTVVAWVDAAWSL | (SEQ ID NO: 2114) |
| *DDPKLYDKDLGSALWDTVVAWVDAATSL$ | (SEQ ID NO: 2115) |
| *DDPKLYDKDLGSALWDTVVAWVDAATSL | (SEQ ID NO: 2116) |
| *DDPKLYDKDLGSALWDTVVAWLDAAWSL$ | (SEQ ID NO: 2117) |
| *DDPKLYDKDLGSALWDTVVAWLDAAWSL | (SEQ ID NO: 2118) |
| *DDPKLYDKDLGSALWDTVVAWLDAATSL$ | (SEQ ID NO: 2119) |
| *DDPKLYDKDLGSALWDTVVAWLDAATSL | (SEQ ID NO: 2120) |
| *DDPKLYDKDLGSALWDTVVAWMDAAWSL$ | (SEQ ID NO: 2121) |
| *DDPKLYDKDLGSALWDTVVAWMDAAWSL | (SEQ ID NO: 2122) |
| *DDPKLYDKDLGSALWDTVVAWMDAATSL$ | (SEQ ID NO: 2123) |
| *DDPKLYDKDLGSALWDTVVAWMDAATSL | (SEQ ID NO: 2124) |
| *DDPKLYDKDLGSALWDTVVAQVDAAWSL$ | (SEQ ID NO: 2125) |
| *DDPKLYDKDLGSALWDTVVAQVDAAWSL | (SEQ ID NO: 2126) |
| *DDPKLYDKDLGSALWDTVVAQVDAATSL$ | (SEQ ID NO: 2127) |
| *DDPKLYDKDLGSALWDTVVAQVDAATSL | (SEQ ID NO: 2128) |
| *DDPKLYDKDLGSALWDTVVAQLDAAWSL$ | (SEQ ID NO: 2129) |
| *DDPKLYDKDLGSALWDTVVAQLDAAWSL | (SEQ ID NO: 2130) |
| *DDPKLYDKDLGSALWDTVVAQLDAATSL$ | (SEQ ID NO: 2131) |
| *DDPKLYDKDLGSALWDTVVAQLDAATSL | (SEQ ID NO: 2132) |
| *DDPKLYDKDLGSALWDTVVAQMDAAWSL$ | (SEQ ID NO: 2133) |
| *DDPKLYDKDLGSALWDTVVAQMDAAWSL | (SEQ ID NO: 2134) |
| *DDPKLYDKDLGSALWDTVVAQMDAATSL$ | (SEQ ID NO: 2135) |
| *DDPKLYDKDLGSALWDTVVAQMDAATSL | (SEQ ID NO: 2136) |

TABLE 3-continued

| Modified Curedoxin-Derived Peptides | |
|---|---|
| *DDPKLYDKDLGSALWDTVVGWVDAAWSL$ | (SEQ ID NO: 2137) |
| *DDPKLYDKDLGSALWDTVVGWVDAAWSL | (SEQ ID NO: 2138) |
| *DDPKLYDKDLGSALWDTVVGWVDAATSL$ | (SEQ ID NO: 2139) |
| *DDPKLYDKDLGSALWDTVVGWVDAATSL | (SEQ ID NO: 2140) |
| *DDPKLYDKDLGSALWDTVVGWLDAAWSL$ | (SEQ ID NO: 2141) |
| *DDPKLYDKDLGSALWDTVVGWLDAAWSL | (SEQ ID NO: 2142) |
| *DDPKLYDKDLGSALWDTVVGWLDAATSL$ | (SEQ ID NO: 2143) |
| *DDPKLYDKDLGSALWDTVVGWLDAATSL | (SEQ ID NO: 2144) |
| *DDPKLYDKDLGSALWDTVVGWMDAAWSL$ | (SEQ ID NO: 2145) |
| *DDPKLYDKDLGSALWDTVVGWMDAAWSL | (SEQ ID NO: 2146) |
| *DDPKLYDKDLGSALWDTVVGWMDAATSL$ | (SEQ ID NO: 2147) |
| *DDPKLYDKDLGSALWDTVVGWMDAATSL | (SEQ ID NO: 2148) |
| *DDPKLYDKDLGSALWDTVVGQVDAAWSL$ | (SEQ ID NO: 2149) |
| *DDPKLYDKDLGSALWDTVVGQVDAAWSL | (SEQ ID NO: 2150) |
| *DDPKLYDKDLGSALWDTVVGQVDAATSL$ | (SEQ ID NO: 2151) |
| *DDPKLYDKDLGSALWDTVVGQVDAATSL | (SEQ ID NO: 2152) |
| *DDPKLYDKDLGSALWDTVVGQLDAAWSL$ | (SEQ ID NO: 2153) |
| *DDPKLYDKDLGSALWDTVVGQLDAAWSL | (SEQ ID NO: 2154) |
| *DDPKLYDKDLGSALWDTVVGQLDAATSL$ | (SEQ ID NO: 2155) |
| *DDPKLYDKDLGSALWDTVVGQLDAATSL | (SEQ ID NO: 2156) |
| *DDPKLYDKDLGSALWDTVVGQMDAAWSL$ | (SEQ ID NO: 2157) |
| *DDPKLYDKDLGSALWDTVVGQMDAAWSL | (SEQ ID NO: 2158) |
| *DDPKLYDKDLGSALWDTVVGQMDAATSL$ | (SEQ ID NO: 2159) |
| *DDPKLYDKDLGSALWDTVVGQMDAATSL | (SEQ ID NO: 2160) |
| *DDPKLYDKDLGSALTDWVVAWVDAAWSL$ | (SEQ ID NO: 2161) |
| *DDPKLYDKDLGSALTDWVVAWVDAAWSL | (SEQ ID NO: 2162) |
| *DDPKLYDKDLGSALTDWVVAWVDAATSL$ | (SEQ ID NO: 2163) |
| *DDPKLYDKDLGSALTDWVVAWVDAATSL | (SEQ ID NO: 2164) |
| *DDPKLYDKDLGSALTDWVVAWLDAAWSL$ | (SEQ ID NO: 2165) |
| *DDPKLYDKDLGSALTDWVVAWLDAAWSL | (SEQ ID NO: 2166) |
| *DDPKLYDKDLGSALTDWVVAWLDAATSL$ | (SEQ ID NO: 2167) |
| *DDPKLYDKDLGSALTDWVVAWLDAATSL | (SEQ ID NO: 2168) |
| *DDPKLYDKDLGSALTDWVVAWMDAAWSL$ | (SEQ ID NO: 2169) |
| *DDPKLYDKDLGSALTDWVVAWMDAAWSL | (SEQ ID NO: 2170) |
| *DDPKLYDKDLGSALTDWVVAWMDAATSL$ | (SEQ ID NO: 2171) |
| *DDPKLYDKDLGSALTDWVVAWMDAATSL | (SEQ ID NO: 2172) |
| *DDPKLYDKDLGSALTDWVVAQVDAAWSL$ | (SEQ ID NO: 2173) |
| *DDPKLYDKDLGSALTDWVVAQVDAAWSL | (SEQ ID NO: 2174) |
| *DDPKLYDKDLGSALTDWVVAQVDAATSL$ | (SEQ ID NO: 2175) |

TABLE 3-continued

| Modified Curedoxin-Derived Peptides | |
|---|---|
| *DDPKLYDKDLGSALTDWVVAQVDAATSL | (SEQ ID NO: 2176) |
| *DDPKLYDKDLGSALTDWVVAQLDAAWSL$ | (SEQ ID NO: 2177) |
| *DDPKLYDKDLGSALTDWVVAQLDAAWSL | (SEQ ID NO: 2178) |
| *DDPKLYDKDLGSALTDWVVAQLDAATSL$ | (SEQ ID NO: 2179) |
| *DDPKLYDKDLGSALTDWVVAQLDAATSL | (SEQ ID NO: 2180) |
| *DDPKLYDKDLGSALTDWVVAQMDAAWSL$ | (SEQ ID NO: 2181) |
| *DDPKLYDKDLGSALTDWVVAQMDAAWSL | (SEQ ID NO: 2182) |
| *DDPKLYDKDLGSALTDWVVAQMDAATSL$ | (SEQ ID NO: 2183) |
| *DDPKLYDKDLGSALTDWVVAQMDAATSL | (SEQ ID NO: 2184) |
| *DDPKLYDKDLGSALTDWVVGWVDAAWSL$ | (SEQ ID NO: 2185) |
| *DDPKLYDKDLGSALTDWVVGWVDAAWSL | (SEQ ID NO: 2186) |
| *DDPKLYDKDLGSALTDWVVGWVDAATSL$ | (SEQ ID NO: 2187) |
| *DDPKLYDKDLGSALTDWVVGWVDAATSL | (SEQ ID NO: 2188) |
| *DDPKLYDKDLGSALTDWVVGWLDAAWSL$ | (SEQ ID NO: 2189) |
| *DDPKLYDKDLGSALTDWVVGWLDAAWSL | (SEQ ID NO: 2190) |
| *DDPKLYDKDLGSALTDWVVGWLDAATSL$ | (SEQ ID NO: 2191) |
| *DDPKLYDKDLGSALTDWVVGWLDAATSL | (SEQ ID NO: 2192) |
| *DDPKLYDKDLGSALTDWVVGWMDAAWSL$ | (SEQ ID NO: 2193) |
| *DDPKLYDKDLGSALTDWVVGWMDAAWSL | (SEQ ID NO: 2194) |
| *DDPKLYDKDLGSALTDWVVGWMDAATSL$ | (SEQ ID NO: 2195) |
| *DDPKLYDKDLGSALTDWVVGWMDAATSL | (SEQ ID NO: 2196) |
| *DDPKLYDKDLGSALTDWVVGQVDAAWSL$ | (SEQ ID NO: 2197) |
| *DDPKLYDKDLGSALTDWVVGQVDAAWSL | (SEQ ID NO: 2198) |
| *DDPKLYDKDLGSALTDWVVGQVDAATSL$ | (SEQ ID NO: 2199) |
| *DDPKLYDKDLGSALTDWVVGQVDAATSL | (SEQ ID NO: 2200) |
| *DDPKLYDKDLGSALTDWVVGQLDAAWSL$ | (SEQ ID NO: 2201) |
| *DDPKLYDKDLGSALTDWVVGQLDAAWSL | (SEQ ID NO: 2202) |
| *DDPKLYDKDLGSALTDWVVGQLDAATSL$ | (SEQ ID NO: 2203) |
| *DDPKLYDKDLGSALTDWVVGQLDAATSL | (SEQ ID NO: 2204) |
| *DDPKLYDKDLGSALTDWVVGQMDAAWSL$ | (SEQ ID NO: 2205) |
| *DDPKLYDKDLGASLTDWVVGQMDAAWSL | (SEQ ID NO: 2206) |
| *DDPKLYDKDLGSALTDWVVGQMDAATSL$ | (SEQ ID NO: 2207) |
| *DDPKLYDKDLGSALTDWVVGQMDAATSL | (SEQ ID NO: 2208) |
| *DDPKLYDKDLGSALTDTVVAWVDAAWSL$ | (SEQ ID NO: 2209) |
| *DDPKLYDKDLGSALTDTVVAWVDAAWSL | (SEQ ID NO: 2210) |
| *DDPKLYDKDLGSALTDTVVAWVDAATSL$ | (SEQ ID NO: 2211) |
| *DDPKLYDKDLGSALTDTVVAWVDAATSL | (SEQ ID NO: 2212) |
| *DDPKLYDKDLGSALTDTVVAWLDAAWSL$ | (SEQ ID NO: 2213) |
| *DDPKLYDKDLGSALTDTVVAWLDAAWSL | (SEQ ID NO: 2214) |

TABLE 3-continued

| Modified Curedoxin-Derived Peptides | |
|---|---|
| *DDPKLYDKDLGSALTDTVVAWLDAATSL$ | (SEQ ID NO: 2215) |
| *DDPKLYDKDLGSALTDTVVAWLDAATSL | (SEQ ID NO: 2216) |
| *DDPKLYDKDLGSALTDTVVAWMDAAWSL$ | (SEQ ID NO: 2217) |
| *DDPKLYDKDLGSALTDTVVAWMDAAWSL | (SEQ ID NO: 2218) |
| *DDPKLYDKDLGSALTDTVVAWMDAATSL$ | (SEQ ID NO: 2219) |
| *DDPKLYDKDLGSALTDTVVAWMDAATSL | (SEQ ID NO: 2220) |
| *DDPKLYDKDLGSALTDTVVAQVDAAWSL$ | (SEQ ID NO: 2221) |
| *DDPKLYDKDLGSALTDTVVAQVDAAWSL | (SEQ ID NO: 2222) |
| *DDPKLYDKDLGSALTDTVVAQVDAATSL$ | (SEQ ID NO: 2223) |
| *DDPKLYDKDLGSALTDTVVAQVDAATSL | (SEQ ID NO: 2224) |
| *DDPKLYDKDLGSALTDTVVAQLDAAWSL$ | (SEQ ID NO: 2225) |
| *DDPKLYDKDLGSALTDTVVAQLDAAWSL | (SEQ ID NO: 2226) |
| *DDPKLYDKDLGSALTDTVVAQLDAATSL$ | (SEQ ID NO: 2227) |
| *DDPKLYDKDLGSALTDTVVAQLDAATSL | (SEQ ID NO: 2228) |
| *DDPKLYDKDLGSALTDTVVAQMDAAWSL$ | (SEQ ID NO: 2229) |
| *DDPKLYDKDLGSALTDTVVAQMDAAWSL | (SEQ ID NO: 2230) |
| *DDPKLYDKDLGSALTDTVVAQMDAATSL$ | (SEQ ID NO: 2231) |
| *DDPKLYDKDLGSALTDTVVAQMDAATSL | (SEQ ID NO: 2232) |
| *DDPKLYDKDLGSALTDTVVGWVDAAWSL$ | (SEQ ID NO: 2233) |
| *DDPKLYDKDLGSALTDTVVGWVDAAWSL | (SEQ ID NO: 2234) |
| *DDPKLYDKDLGSALTDTVVGWVDAATSL$ | (SEQ ID NO: 2235) |
| *DDPKLYDKDLGSALTDTVVGWVDAATSL | (SEQ ID NO: 2236) |
| *DDPKLYDKDLGSALTDTVVGWLDAAWSL$ | (SEQ ID NO: 2237) |
| *DDPKLYDKDLGSALTDTVVGWLDAAWSL | (SEQ ID NO: 2238) |
| *DDPKLYDKDLGSALTDTVVGWLDAATSL$ | (SEQ ID NO: 2239) |
| *DDPKLYDKDLGSALTDTVVGWLDAATSL | (SEQ ID NO: 2240) |
| *DDPKLYDKDLGSALTDTVVGWMDAAWSL$ | (SEQ ID NO: 2241) |
| *DDPKLYDKDLGSALTDTVVGWMDAAWSL | (SEQ ID NO: 2242) |
| *DDPKLYDKDLGSALTDTVVGWMDAATSL$ | (SEQ ID NO: 2243) |
| *DDPKLYDKDLGSALTDTVVGWMDAATSL | (SEQ ID NO: 2244) |
| *DDPKLYDKDLGSALTDTVVGQVDAAWSL$ | (SEQ ID NO: 2245) |
| *DDPKLYDKDLGSALTDTVVGQVDAAWSL | (SEQ ID NO: 2246) |
| *DDPKLYDKDLGSALTDTVVGQVDAATSL$ | (SEQ ID NO: 2247) |
| *DDPKLYDKDLGSALTDTVVGQVDAATSL | (SEQ ID NO: 2248) |
| *DDPKLYDKDLGSALTDTVVGQLDAAWSL$ | (SEQ ID NO: 2249) |
| *DDPKLYDKDLGSALTDTVVGQLDAAWSL | (SEQ ID NO: 2250) |
| *DDPKLYDKDLGSALTDTVVGQLDAATSL$ | (SEQ ID NO: 2251) |
| *DDPKLYDKDLGSALTDTVVGQLDAATSL | (SEQ ID NO: 2252) |
| *DDPKLYDKDLGSALTDTVVGQMDAAWSL$ | (SEQ ID NO: 2253) |

TABLE 3-continued

| Modified Curedoxin-Derived Peptides | |
|---|---|
| *DDPKLYDKDLGSALTDTVVGQMDAAWSL | (SEQ ID NO: 2254) |
| *DDPKLYDKDLGSALTDTVVGQMDAATSL$ | (SEQ ID NO: 2255) |
| *DDPKLYDKDLGSALTDTVVGQMDAATSL | (SEQ ID NO: 2256) |
| *DDPKLYDKDLGSALGDWVVAWVDAAWSL$ | (SEQ ID NO: 2257) |
| *DDPKLYDKDLGSALGDWVVAWVDAAWSL | (SEQ ID NO: 2258) |
| *DDPKLYDKDLGSALGDWVVAWVDAATSL$ | (SEQ ID NO: 2259) |
| *DDPKLYDKDLGSALGDWVVAWVDAATSL | (SEQ ID NO: 2260) |
| *DDPKLYDKDLGSALGDWVVAWLDAAWSL$ | (SEQ ID NO: 2261) |
| *DDPKLYDKDLGSALGDWVVAWLDAAWSL | (SEQ ID NO: 2262) |
| *DDPKLYDKDLGSALGDWVVAWLDAATSL$ | (SEQ ID NO: 2263) |
| *DDPKLYDKDLGSALGDWVVAWLDAATSL | (SEQ ID NO: 2264) |
| *DDPKLYDKDLGSALGDWVVAWMDAAWSL$ | (SEQ ID NO: 2265) |
| *DDPKLYDKDLGSALGDWVVAWMDAAWSL | (SEQ ID NO: 2266) |
| *DDPKLYDKDLGSALGDWVVAWMDAATSL$ | (SEQ ID NO: 2267) |
| *DDPKLYDKDLGSALGDWVVAWMDAATSL | (SEQ ID NO: 2268) |
| *DDPKLYDKDLGSALGDWVVAQVDAAWSL$ | (SEQ ID NO: 2269) |
| *DDPKLYDKDLGSALGDWVVAQVDAAWSL | (SEQ ID NO: 2270) |
| *DDPKLYDKDLGSALGDWVVAQVDAATSL$ | (SEQ ID NO: 2271) |
| *DDPKLYDLDLGSALGDWVVAQVDAATSL | (SEQ ID NO: 2272) |
| *DDPKLYDKDLGSALGDWVVAQLDAAWSL$ | (SEQ ID NO: 2273) |
| *DDPKLYDKDLGSALGDWVVAQLDAAWSL | (SEQ ID NO: 2274) |
| *DDPKLYDKDLGSALGDWVVAQLDAATSL$ | (SEQ ID NO: 2275) |
| *DDPKLYDKDLGSALGDWVVAQLDAATSL | (SEQ ID NO: 2276) |
| *DDPKLYDKDLGSALGDWVVAQMDAAWSL$ | (SEQ ID NO: 2277) |
| *DDPKLYDKDLGSALGDWVVAQMDAAWSL | (SEQ ID NO: 2278) |
| *DDPKLYDKDLGSALGDWVVAQMDAATSL$ | (SEQ ID NO: 2279) |
| *DDPKLYDKDLGSALGDWVVAQMDAATSL | (SEQ ID NO: 2280) |
| *DDPKLYDKDLGSALGDWVVGWVDAAWSL$ | (SEQ ID NO: 2281) |
| *DDPKLYDKDLGSALGDWVVGWVDAAWSL | (SEQ ID NO: 2282) |
| *DDPKLYDKDLGSALGDWVVGWVDAATSL$ | (SEQ ID NO: 2283) |
| *DDPKLYDKDLGSALGDWVVGWVDAATSL | (SEQ ID NO: 2284) |
| *DDPKLYDKDLGSALGDWVVGWLDAAWSL$ | (SEQ ID NO: 2285) |
| *DDPKLYDKDLGSALGDWVVGWLDAAWSL | (SEQ ID NO: 2286) |
| *DDPKLYDKDLGSALGDWVVGWLDAATSL$ | (SEQ ID NO: 2287) |
| *DDPKLYDKDLGSALGDWVVGWLDAATSL | (SEQ ID NO: 2288) |
| *DDPKLYDKDLGSALGDWVVGWMDAAWSL$ | (SEQ ID NO: 2289) |
| *DDPKLYDKDLGSALGDWVVGWMDAAWSL | (SEQ ID NO: 2290) |
| *DDPKLYDKDLGSALGDWVVGWMDAATSL$ | (SEQ ID NO: 2291) |
| *DDPKLYDKDLGSALGDWVVGWMDAATSL | (SEQ ID NO: 2292) |

TABLE 3-continued

| Modified Curedoxin-Derived Peptides | |
|---|---|
| *DDPKLYDKDLGSALGDWVVGQVDAAWSL$ | (SEQ ID NO: 2293) |
| *DDPKLYDKDLGSALGDWVVGQVDAAWSL | (SEQ ID NO: 2294) |
| *DDPKLYDKDLGSALGDWVVGQVDAATSL$ | (SEQ ID NO: 2295) |
| *DDPKLYDKDLGSALGDWVVGQVDAATSL | (SEQ ID NO: 2296) |
| *DDPKLYDKDLGSALGDWVVGQLDAAWSL$ | (SEQ ID NO: 2297) |
| *DDPKLYDKDLGSALGDWVVGQLDAAWSL | (SEQ ID NO: 2298) |
| *DDPKLYDKDLGSALGDWVVGQLDAATSL$ | (SEQ ID NO: 2299) |
| *DDPKLYDKDLGSALGDWVVGQLDAATSL | (SEQ ID NO: 2300) |
| *DDPKLYDKDLGSALGDWVVGQMDAAWSL$ | (SEQ ID NO: 2301) |
| *DDPKLYDKDLGSALGDWVVGQMDAAWSL | (SEQ ID NO: 2302) |
| *DDPKLYDKDLGSALGDWVVGQMDAATSL$ | (SEQ ID NO: 2303) |
| *DDPKLYDKDLGSALGDWVVGQMDAATSL | (SEQ ID NO: 2304) |
| *DDPKLYDKDLGSALGDTVVAWVDAAWSL$ | (SEQ ID NO: 2305) |
| *DDPKLYDKDLGSALGDTVVAWVDAAWSL | (SEQ ID NO: 2306) |
| *DDPKLYDKDLGSALGDTVVAWVDAATSL$ | (SEQ ID NO: 2307) |
| *DDPKLYDKDLGSALGDTVVAWVDAATSL | (SEQ ID NO: 2308) |
| *DDPKLYDKDLGSALGDTVVAWLDAAWSL$ | (SEQ ID NO: 2309) |
| *DDPKLYDKDLGSALGDTVVAWLDAAWSL | (SEQ ID NO: 2310) |
| *DDPKLYDKDLGSALGDTVVAWLDAATSL$ | (SEQ ID NO: 2311) |
| *DDPKLYDKDLGSALGDTVVAWLDAATSL | (SEQ ID NO: 2312) |
| *DDPKLYDKDLGSALGDTVVAWMDAAWSL$ | (SEQ ID NO: 2313) |
| *DDPKLYDKDLGSALGDTVVAWMDAAWSL | (SEQ ID NO: 2314) |
| *DDPKLYDKDLGSALGDTVVAWMDAATSL$ | (SEQ ID NO: 2315) |
| *DDPKLYDKDLGSALGDTVVAWMDAATSL | (SEQ ID NO: 2316) |
| *DDPKLYDKDLGSALGDTVVAQVDAAWSL$ | (SEQ ID NO: 2317) |
| *DDPKLYDKDLGSALGDTVVAQVDAAWSL | (SEQ ID NO: 2318) |
| *DDPKLYDKDLGSALGDTVVAQVDAATSL$ | (SEQ ID NO: 2319) |
| *DDPKLYDKDLGSALGDTVVAQVDAATSL | (SEQ ID NO: 2320) |
| *DDPKLYDKDLGSALGDTVVAQLDAAWSL$ | (SEQ ID NO: 2321) |
| *DDPKLYDKDLGSALGDTVVAQLDAAWSL | (SEQ ID NO: 2322) |
| *DDPKLYDKDLGSALGDTVVAQLDAATSL$ | (SEQ ID NO: 2323) |
| *DDPKLYDKDLGSALGDTVVAQLDAATSL | (SEQ ID NO: 2324) |
| *DDPKLYDKDLGSALGDTVVAQMDAAWSL$ | (SEQ ID NO: 2325) |
| *DDPKLYDKDLGSALGDTVVAQMDAAWSL | (SEQ ID NO: 2326) |
| *DDPKLYDKDLGSALGDTVVAQMDAATSL$ | (SEQ ID NO: 2327) |
| *DDPKLYDKDLGSALGDTVVAQMDAATSL | (SEQ ID NO: 2328) |
| *DDPKLYDKDLGSALGDTVVGWVDAAWSL$ | (SEQ ID NO: 2329) |
| *DDPKLYDKDLGSALGDTVVGWVDAAWSL | (SEQ ID NO: 2330) |
| *DDPKLYDKDLGSALGDTVVGWVDAATSL$ | (SEQ ID NO: 2331) |

TABLE 3-continued

| Modified Curedoxin-Derived Peptides | |
|---|---|
| *DDPKLYDKDLGSALGDTVVGWVDAATSL | (SEQ ID NO: 2332) |
| *DDPKLYDKDLGSALGDTVVGWLDAAWSL$ | (SEQ ID NO: 2333) |
| *DDPKLYDKDLGSALGDTVVGWLDAAWSL | (SEQ ID NO: 2334) |
| *DDPKLYDKDLGSALGDTVVGWLDAATSL$ | (SEQ ID NO: 2335) |
| *DDPKLYDKDLGSALGDTVVGWLDAATSL | (SEQ ID NO: 2336) |
| *DDPKLYDKDLGSALGDTVVGWMDAAWSL$ | (SEQ ID NO: 2337) |
| *DDPKLYDKDLGSALGDTVVGWMDAAWSL | (SEQ ID NO: 2338) |
| *DDPKLYDKDLGSALGDTVVGWMDAATSL$ | (SEQ ID NO: 2339) |
| *DDPKLYDKDLGSALGDTVVGWMDAATSL | (SEQ ID NO: 2340) |
| *DDPKLYDKDLGSALGDTVVGQVDAAWSL$ | (SEQ ID NO: 2341) |
| *DDPKLYDKDLGSALGDTVVGQVDAAWSL | (SEQ ID NO: 2342) |
| *DDPKLYDKDLGSALGDTVVGQVDAATSL$ | (SEQ ID NO: 2343) |
| *DDPKLYDKDLGSALGDTVVGQVDAATSL | (SEQ ID NO: 2344) |
| *DDPKLYDKDLGSALGDTVVGQLDAAWSL$ | (SEQ ID NO: 2345) |
| *DDPKLYDKDLGSALGDTVVGQLDAAWSL | (SEQ ID NO: 2346) |
| *DDPKLYDKDLGSALGDTVVGQLDAATSL$ | (SEQ ID NO: 2347) |
| *DDPKLYDKDLGSALGDTVVGQLDAATSL | (SEQ ID NO: 2348) |
| *DDPKLYDKDLGSALGDTVVGQMDAAWSL$ | (SEQ ID NO: 2349) |
| *DDPKLYDKDLGSALGDTVVGQMDAAWSL | (SEQ ID NO: 2350) |
| *DDPKLYDKDLGSALGDTVVGQMDAATSL$ | (SEQ ID NO: 2351) |
| *DDPKLYDKDLGSALGDTVVGQMDAATSL | (SEQ ID NO: 2352) |
| *DDPKLYDKDLGSAMWDWVVAWVDAAWSL$ | (SEQ ID NO: 2353) |
| *DDPKLYDKDLGSAMWDWVVAWVDAAWSL | (SEQ ID NO: 2354) |
| *DDPKLYDKDLGSAMWDWVVAWVDAATSL$ | (SEQ ID NO: 2355) |
| *DDPKLYDKDLGSAMWDWVVAWVDAATSL | (SEQ ID NO: 2356) |
| *DDPKLYDKDLGSAMWDWVVAWLDAAWSL$ | (SEQ ID NO: 2357) |
| *DDPKLYDKDLGSAMWDWVVAWLDAAWSL | (SEQ ID NO: 2358) |
| *DDPKLYDKDLGSAMWDWVVAWLDAATSL$ | (SEQ ID NO: 2359) |
| *DDPKLYDKDLGSAMWDWVVAWLDAATSL | (SEQ ID NO: 2360) |
| *DDPKLYDKDLGSAMWDWVVAWMDAAWSL$ | (SEQ ID NO: 2361) |
| *DDPKLYDKDLGSAMWDWVVAWMDAAWSL | (SEQ ID NO: 2362) |
| *DDPKLYDKDLGSAMWDWVVAWMDAATSL$ | (SEQ ID NO: 2363) |
| *DDPKLYDKDLGSAMWDWVVAWMDAATSL | (SEQ ID NO: 2364) |
| *DDPKLYDKDLGSAMWDWVVAQVDAAWSL$ | (SEQ ID NO: 2365) |
| *DDPKLYDKDLGSAMWDWVVAQVDAAWSL | (SEQ ID NO: 2366) |
| *DDPKLYDKDLGSAMWDWVVAQVDAATSL$ | (SEQ ID NO: 2367) |
| *DDPKLYDKDLGSAMWDWVVAQVDAATSL | (SEQ ID NO: 2368) |
| *DDPKLYDKDLGSAMWDWVVAQLDAAWSL$ | (SEQ ID NO: 2369) |
| *DDPKLYDKDLGSAMWDWVVAQLDAAWSL | (SEQ ID NO: 2370) |

TABLE 3-continued

| Modified Curedoxin-Derived Peptides | |
|---|---|
| *DDPKLYDKDLGSAMWDWVVAQLDAATSL$ | (SEQ ID NO: 2371) |
| *DDPKLYDKDLGSAMWDWVVAQLDAATSL | (SEQ ID NO: 2372) |
| *DDPKLYDKDLGSAMWDWVVAQMDAAWSL$ | (SEQ ID NO: 2373) |
| *DDPKLYDKDLGSAMWDWVVAQMDAAWSL | (SEQ ID NO: 2374) |
| *DDPKLYDKDLGSAMWDWVVAQMDAATSL$ | (SEQ ID NO: 2375) |
| *DDPKLYDKDLGSAMWDWVVAQMDAATSL | (SEQ ID NO: 2376) |
| *DDPKLYDKDLGSAMWDWVVGWVDAAWSL$ | (SEQ ID NO: 2377) |
| *DDPKLYDKDLGSAMWDWVVGWVDAAWSL | (SEQ ID NO: 2378) |
| *DDPKLYDKDLGSAMWDWVVGWVDAATSL$ | (SEQ ID NO: 2379) |
| *DDPKLYDKDLGSAMWDWVVGWVDAATSL | (SEQ ID NO: 2380) |
| *DDPKLYDKDLGSAMWDWVVGWLDAAWSL$ | (SEQ ID NO: 2381) |
| *DDPKLYDKDLGSAMWDWVVGWLDAAWSL | (SEQ ID NO: 2382) |
| *DDPKLYDKDLGSAMWDWVVGWLDAATSL$ | (SEQ ID NO: 2383) |
| *DDPKLYDKDLGSAMWDWVVGWLDAATSL | (SEQ ID NO: 2384) |
| *DDPKLYDKDLGSAMWDWVVGWMDAAWSL$ | (SEQ ID NO: 2385) |
| *DDPKLYDKDLGSAMWDWVVGWMDAAWSL | (SEQ ID NO: 2386) |
| *DDPKLYDKDLGSAMWDWVVGWMDAATSL$ | (SEQ ID NO: 2387) |
| *DDPKLYDKDLGSAMWDWVVGWMDAATSL | (SEQ ID NO: 2388) |
| *DDPKLYDKDLGSAMWDWVVGQVDAAWSL$ | (SEQ ID NO: 2389) |
| *DDPKLYDKDLGSAMWDWVVGQVDAAWSL | (SEQ ID NO: 2390) |
| *DDPKLYDKDLGSAMWDWVVGQVDAATSL$ | (SEQ ID NO: 2391) |
| *DDPKLYDKDLGSAMWDWVVGQVDAATSL | (SEQ ID NO: 2392) |
| *DDPKLYDKDLGSAMWDWVVGQLDAAWSL$ | (SEQ ID NO: 2393) |
| *DDPKLYDKDLGSAMWDWVVGQLDAAWSL | (SEQ ID NO: 2394) |
| *DDPKLYDKDLGSAMWDWVVGQLDAATSL$ | (SEQ ID NO: 2395) |
| *DDPKLYDKDLGSAMWDWVVGQLDAATSL | (SEQ ID NO: 2396) |
| *DDPKLYDKDLGSAMWDWVVGQMDAAWSL$ | (SEQ ID NO: 2397) |
| *DDPKLYDKDLGSAMWDWVVGQMDAAWSL | (SEQ ID NO: 2398) |
| *DDPKLYDKDLGSAMWDWVVGQMDAATSL$ | (SEQ ID NO: 2399) |
| *DDPKLYDKDLGSAMWDWVVGQMDAATSL | (SEQ ID NO: 2400) |
| *DDPKLYDKDLGSAMWDTVVAWVDAAWSL$ | (SEQ ID NO: 2401) |
| *DDPKLYDKDLGSAMWDTVVAWVDAAWSL | (SEQ ID NO: 2402) |
| *DDPKLYDKDLGSAMWDTVVAWVDAATSL$ | (SEQ ID NO: 2403) |
| *DDPKLYDKDLGSAMWDTVVAWVDAATSL | (SEQ ID NO: 2404) |
| *DDPKLYDKDLGSAMWDTVVAWLDAAWSL$ | (SEQ ID NO: 2405) |
| *DDPKLYDKDLGSAMWDTVVAWLDAAWSL | (SEQ ID NO: 2406) |
| *DDPKLYDKDLGSAMWDTVVAWLDAATSL$ | (SEQ ID NO: 2407) |
| *DDPKLYDKDLGSAMWDTVVAWLDAATSL | (SEQ ID NO: 2408) |
| *DDPKLYDKDLGSAMWDTVVAWMDAAWSL$ | (SEQ ID NO: 2409) |

TABLE 3-continued

| Modified Curedoxin-Derived Peptides | |
|---|---|
| *DDPKLYDKDLGSAMWDTVVAWMDAAWSL | (SEQ ID NO: 2410) |
| *DDPKLYDKDLGSAMWDTVVAWMDAATSL$ | (SEQ ID NO: 2411) |
| *DDPKLYDKDLGSAMWDTVVAWMDAATSL | (SEQ ID NO: 2412) |
| *DDPKLYDKDLGSAMWDTVVAQVDAAWSL$ | (SEQ ID NO: 2413) |
| *DDPKLYDKDLGSAMWDTVVAQVDAAWSL | (SEQ ID NO: 2414) |
| *DDPKLYDKDLGSAMWDTVVAQVDAATSL$ | (SEQ ID NO: 2415) |
| *DDPKLYDKDLGSAMWDTVVAQVDAATSL | (SEQ ID NO: 2416) |
| *DDPKLYDKDLGSAMWDTVVAQLDAAWSL$ | (SEQ ID NO: 2417) |
| *DDPKLYDKDLGSAMWDTVVAQLDAAWSL | (SEQ ID NO: 2418) |
| *DDPKLYDKDLGSAMWDTVVAQLDAATSL$ | (SEQ ID NO: 2419) |
| *DDPKLYDKDLGSAMWDTVVAQLDAATSL | (SEQ ID NO: 2420) |
| *DDPKLYDKDLGSAMWDTVVAQMDAAWSL$ | (SEQ ID NO: 2421) |
| *DDPKLYDKDLGSAMWDTVVAQMDAAWSL | (SEQ ID NO: 2422) |
| *DDPKLYDKDLGSAMWDTVVAQMDAATSL$ | (SEQ ID NO: 2423) |
| *DDPKLYDKDLGSAMWDTVVAQMDAATSL | (SEQ ID NO: 2424) |
| *DDPKLYDKDLGSAMWDTVVGWVDAAWSL$ | (SEQ ID NO: 2425) |
| *DDPKLYDKDLGSAMWDTVVGWVDAAWSL | (SEQ ID NO: 2426) |
| *DDPKLYDKDLGSAMWDTVVGWVDAATSL$ | (SEQ ID NO: 2427) |
| *DDPKLYDKDLGSAMWDTVVGWVDAATSL | (SEQ ID NO: 2428) |
| *DDPKLYDKDLGSAMWDTVVGWLDAAWSL$ | (SEQ ID NO: 2429) |
| *DDPKLYDKDLGSAMWDTVVGWLDAAWSL | (SEQ ID NO: 2430) |
| *DDPKLYDKDLGSAMWDTVVGWLDAATSL$ | (SEQ ID NO: 2431) |
| *DDPKLYDKDLGSAMWDTVVGWLDAATSL | (SEQ ID NO: 2432) |
| *DDPKLYDKDLGSAMWDTVVGWMDAAWSL$ | (SEQ ID NO: 2433) |
| *DDPKLYDKDLGSAMWDTVVGWMDAAWSL | (SEQ ID NO: 2434) |
| *DDPKLYDKDLGSAMWDTVVGWMDAATSL$ | (SEQ ID NO: 2435) |
| *DDPKLYDKDLGSAMWDTVVGWMDAATSL | (SEQ ID NO: 2436) |
| *DDPKLYDKDLGSAMWDTVVGQVDAAWSL$ | (SEQ ID NO: 2437) |
| *DDPKLYDKDLGSAMWDTVVGQVDAAWSL | (SEQ ID NO: 2438) |
| *DDPKLYDKDLGSAMWDTVVGQVDAATSL$ | (SEQ ID NO: 2439) |
| *DDPKLYDKDLGSAMWDTVVGQVDAATSL | (SEQ ID NO: 2440) |
| *DDPKLYDKDLGSAMWDTVVGQLDAAWSL$ | (SEQ ID NO: 2441) |
| *DDPKLYDKDLGSAMWDTVVGQLDAAWSL | (SEQ ID NO: 2442) |
| *DDPKLYDKDLGSAMWDTVVGQLDAATSL$ | (SEQ ID NO: 2443) |
| *DDPKLYDKDLGSAMWDTVVGQLDAATSL | (SEQ ID NO: 2444) |
| *DDPKLYDKDLGSAMWDTVVGQMDAAWSL$ | (SEQ ID NO: 2445) |
| *DDPKLYDKDLGSAMWDTVVGQMDAAWSL | (SEQ ID NO: 2446) |
| *DDPKLYDKDLGSAMWDTVVGQMDAATSL$ | (SEQ ID NO: 2447) |
| *DDPKLYDKDLGSAMWDTVVGQMDAATSL | (SEQ ID NO: 2448) |

TABLE 3-continued

| Modified Curedoxin-Derived Peptides | |
|---|---|
| *DDPKLYDKDLGSAMTDWVVAWVDAAWSL$ | (SEQ ID NO: 2449) |
| *DDPKLYDKDLGSAMTDWVVAWVDAAWSL | (SEQ ID NO: 2450) |
| *DDPKLYDKDLGSAMTDWVVAWVDAATSL$ | (SEQ ID NO: 2451) |
| *DDPKLYDKDLGSAMTDWVVAWVDAATSL | (SEQ ID NO: 2452) |
| *DDPKLYDKDLGSAMTDWVVAWLDAAWSL$ | (SEQ ID NO: 2453) |
| *DDPKLYDKDLGSAMTDWVVAWLDAAWSL | (SEQ ID NO: 2454) |
| *DDPKLYDKDLGSAMTDWVVAWLDAATSL$ | (SEQ ID NO: 2455) |
| *DDPKLYDKDLGSAMTDWVVAWLDAATSL | (SEQ ID NO: 2456) |
| *DDPKLYDKDLGSAMTDWVVAWMDAAWSL$ | (SEQ ID NO: 2457) |
| *DDPKLYDKDLGSAMTDWVVAWMDAAWSL | (SEQ ID NO: 2458) |
| *DDPKLYDKDLGSAMTDWVVAWMDAATSL$ | (SEQ ID NO: 2459) |
| *DDPKLYDKDLGSAMTDWVVAWMDAATSL | (SEQ ID NO: 2460) |
| *DDPKLYDKDLGSAMTDWVVAQVDAAWSL$ | (SEQ ID NO: 2461) |
| *DDPKLYDKDLGSAMTDWVVAQVDAAWSL | (SEQ ID NO: 2462) |
| *DDPKLYDKDLGSAMTDWVVAQVDAATSL$ | (SEQ ID NO: 2463) |
| *DDPKLYDKDLGSAMTDWVVAQVDAATSL | (SEQ ID NO: 2464) |
| *DDPKLYDKDLGSAMTDWVVAQLDAAWSL$ | (SEQ ID NO: 2465) |
| *DDPKLYDKDLGSAMTDWVVAQLDAAWSL | (SEQ ID NO: 2466) |
| *DDPKLYDKDLGSAMTDWVVAQLDAATSL$ | (SEQ ID NO: 2467) |
| *DDPKLYDKDLGSAMTDWVVAQLDAATSL | (SEQ ID NO: 2468) |
| *DDPKLYDKDLGSAMTDWVVAQMDAAWSL$ | (SEQ ID NO: 2469) |
| *DDPKLYDKDLGSAMTDWVVAQMDAAWSL | (SEQ ID NO: 2470) |
| *DDPKLYDKDLGSAMTDWVVAQMDAATSL$ | (SEQ ID NO: 2471) |
| *DDPKLYDKDLGSAMTDWVVAQMDAATSL | (SEQ ID NO: 2472) |
| *DDPKLYDKDLGSAMTDWVVGWVDAAWSL$ | (SEQ ID NO: 2473) |
| *DDPKLYDKDLGSAMTDWVVGWVDAAWSL | (SEQ ID NO: 2474) |
| *DDPKLYDKDLGSAMTDWVVGWVDAATSL$ | (SEQ ID NO: 2475) |
| *DDPKLYDKDLGSAMTDWVVGWVDAATSL | (SEQ ID NO: 2476) |
| *DDPKLYDKDLGSAMTDWVVGWLDAAWSL$ | (SEQ ID NO: 2477) |
| *DDPKLYDKDLGSAMTDWVVGWLDAAWSL | (SEQ ID NO: 2478) |
| *DDPKLYDKDLGSAMTDWVVGWLDAATSL$ | (SEQ ID NO: 2479) |
| *DDPKLYDKDLGSAMTDWVVGWLDAATSL | (SEQ ID NO: 2480) |
| *DDPKLYDKDLGSAMTDWVVGWMDAAWSL$ | (SEQ ID NO: 2481) |
| *DDPKLYDKDLGSAMTDWVVGWMDAAWSL | (SEQ ID NO: 2482) |
| *DDPKLYDKDLGSAMTDWVVGWMDAATSL$ | (SEQ ID NO: 2483) |
| *DDPKLYDKDLGSAMTDWVVGWMDAATSL | (SEQ ID NO: 2484) |
| *DDPKLYDKDLGSAMTDWVVGQVDAAWSL$ | (SEQ ID NO: 2485) |
| *DDPKLYDKDLGSAMTDWVVGQVDAAWSL | (SEQ ID NO: 2486) |
| *DDPKLYDKDLGSAMTDWVVGQVDAATSL$ | (SEQ ID NO: 2487) |

TABLE 3-continued

| Modified Curedoxin-Derived Peptides | |
|---|---|
| *DDPKLYDKDLGSAMTDWVVGQVDAATSL | (SEQ ID NO: 2488) |
| *DDPKLYDKDLGSAMTDWVVGQLDAAWSL$ | (SEQ ID NO: 2489) |
| *DDPKLYDKDLGSAMTDWVVGQLDAAWSL | (SEQ ID NO: 2490) |
| *DDPKLYDKDLGSAMTDWVVGQLDAATSL$ | (SEQ ID NO: 2491) |
| *DDPKLYDKDLGSAMTDWVVGQLDAATSL | (SEQ ID NO: 2492) |
| *DDPKLYDKDLGSAMTDWVVGQMDAAWSL$ | (SEQ ID NO: 2493) |
| *DDPKLYDKDLGSAMTDWVVGQMDAAWSL | (SEQ ID NO: 2494) |
| *DDPKLYDKDLGSAMTDWVVGQMDAATSL$ | (SEQ ID NO: 2495) |
| *DDPKLYDKDLGSAMTDWVVGQMDAATSL | (SEQ ID NO: 2496) |
| *DDPKLYDKDLGSAMTDTVVAWVDAAWSL$ | (SEQ ID NO: 2497) |
| *DDPKLYDKDLGSAMTDTVVAWVDAAWSL | (SEQ ID NO: 2498) |
| *DDPKLYDKDLGSAMTDTVVAWVDAATSL$ | (SEQ ID NO: 2499) |
| *DDPKLYDKDLGSAMTDTVVAWVDAATSL | (SEQ ID NO: 2500) |
| *DDPKLYDKDLGSAMTDTVVAWLDAAWSL$ | (SEQ ID NO: 2501) |
| *DDPKLYDKDLGSAMTDTVVAWLDAAWSL | (SEQ ID NO: 2502) |
| *DDPKLYDKDLGSAMTDTVVAWLDAATSL$ | (SEQ ID NO: 2503) |
| *DDPKLYDKDLGSAMTDTVVAWLDAATSL | (SEQ ID NO: 2504) |
| *DDPKLYDKDLGSAMTDTVVAWMDAAWSL$ | (SEQ ID NO: 2505) |
| *DDPKLYDKDLGSAMTDTVVAWMDAAWSL | (SEQ ID NO: 2506) |
| *DDPKLYDKDLGSAMTDTVVAWMDAATSL$ | (SEQ ID NO: 2507) |
| *DDPKLYDKDLGSAMTDTVVAWMDAATSL | (SEQ ID NO: 2508) |
| *DDPKLYDKDLGSAMTDTVVAQVDAAWSL$ | (SEQ ID NO: 2509) |
| *DDPKLYDKDLGSAMTDTVVAQVDAAWSL | (SEQ ID NO: 2510) |
| *DDPKLYDKDLGSAMTDTVVAQVDAATSL$ | (SEQ ID NO: 2511) |
| *DDPKLYDKDLGSAMTDTVVAQVDAATSL | (SEQ ID NO: 2512) |
| *DDPKLYDKDLGSAMTDTVVAQLDAAWSL$ | (SEQ ID NO: 2513) |
| *DDPKLYDKDLGSAMTDTVVAQLDAAWSL | (SEQ ID NO: 2514) |
| *DDPKLYDKDLGSAMTDTVVAQLDAATSL$ | (SEQ ID NO: 2515) |
| *DDPKLYDKDLGSAMTDTVVAQLDAATSL | (SEQ ID NO: 2516) |
| *DDPKLYDKDLGSAMTDTVVAQMDAAWSL$ | (SEQ ID NO: 2517) |
| *DDPKLYDKDLGSAMTDTVVAQMDAAWSL | (SEQ ID NO: 2518) |
| *DDPKLYDKDLGSAMTDTVVAQMDAATSL$ | (SEQ ID NO: 2519) |
| *DDPKLYDKDLGSAMTDTVVAQMDAATSL | (SEQ ID NO: 2520) |
| *DDPKLYDKDLGSAMTDTVVGWVDAAWSL$ | (SEQ ID NO: 2521) |
| *DDPKLYDKDLGSAMTDTVVGWVDAAWSL | (SEQ ID NO: 2522) |
| *DDPKLYDKDLGSAMTDTVVGWVDAATSL$ | (SEQ ID NO: 2523) |
| *DDPKLYDKDLGSAMTDTVVGWVDAATSL | (SEQ ID NO: 2524) |
| *DDPKLYDKDLGSAMTDTVVGWLDAAWSL$ | (SEQ ID NO: 2525) |
| *DDPKLYDKDLGSAMTDTVVGWLDAAWSL | (SEQ ID NO: 2526) |

TABLE 3-continued

| Modified Curedoxin-Derived Peptides | |
|---|---|
| *DDPKLYDKDLGSAMTDTVVGWLDAATSL$ | (SEQ ID NO: 2527) |
| *DDPKLYDKDLGSAMTDTVVGWLDAATSL | (SEQ ID NO: 2528) |
| *DDPKLYDKDLGSAMTDTVVGWMDAAWSL$ | (SEQ ID NO: 2529) |
| *DDPKLYDKDLGSAMTDTVVGWMDAAWSL | (SEQ ID NO: 2530) |
| *DDPKLYDKDLGSAMTDTVVGWMDAATSL$ | (SEQ ID NO: 2531) |
| *DDPKLYDKDLGSAMTDTVVGWMDAATSL | (SEQ ID NO: 2532) |
| *DDPKLYDKDLGSAMTDTVVGQVDAAWSL$ | (SEQ ID NO: 2533) |
| *DDPKLYDKDLGSAMTDTVVGQVDAAWSL | (SEQ ID NO: 2534) |
| *DDPKLYDKDLGSAMTDTVVGQVDAATSL$ | (SEQ ID NO: 2535) |
| *DDPKLYDKDLGSAMTDTVVGQVDAATSL | (SEQ ID NO: 2536) |
| *DDPKLYDKDLGSAMTDTVVGQLDAAWSL$ | (SEQ ID NO: 2537) |
| *DDPKLYDKDLGSAMTDTVVGQLDAAWSL | (SEQ ID NO: 2538) |
| *DDPKLYDKDLGSAMTDTVVGQLDAATSL$ | (SEQ ID NO: 2539) |
| *DDPKLYDKDLGSAMTDTVVGQLDAATSL | (SEQ ID NO: 2540) |
| *DDPKLYDKDLGSAMTDTVVGQMDAAWSL$ | (SEQ ID NO: 2541) |
| *DDPKLYDKDLGSAMTDTVVGQMDAAWSL | (SEQ ID NO: 2542) |
| *DDPKLYDKDLGSAMTDTVVGQMDAATSL$ | (SEQ ID NO: 2543) |
| *DDPKLYDKDLGSAMTDTVVGQMDAATSL | (SEQ ID NO: 2544) |
| *DDPKLYDKDLGSAMGDWVVAWVDAAWSL$ | (SEQ ID NO: 2545) |
| *DDPKLYDKDLGSAMGDWVVAWVDAAWSL | (SEQ ID NO: 2546) |
| *DDPKLYDKDLGSAMGDWVVAWVDAATSL$ | (SEQ ID NO: 2547) |
| *DDPKLYDKDLGSAMGDWVVAWVDAATSL | (SEQ ID NO: 2548) |
| *DDPKLYDKDLGSAMGDWVVAWLDAAWSL$ | (SEQ ID NO: 2549) |
| *DDPKLYDKDLGSAMGDWVVAWLDAAWSL | (SEQ ID NO: 2550) |
| *DDPKLYDKDLGSAMGDWVVAWLDAATSL$ | (SEQ ID NO: 2551) |
| *DDPKLYDKDLGSAMGDWVVAWLDAATSL | (SEQ ID NO: 2552) |
| *DDPKLYDKDLGSAMGDWVVAWMDAAWSL$ | (SEQ ID NO: 2553) |
| *DDPKLYDKDLGSAMGDWVVAWMDAAWSL | (SEQ ID NO: 2554) |
| *DDPKLYDKDLGSAMGDWVVAWMDAATSL$ | (SEQ ID NO: 2555) |
| *DDPKLYDKDLGSAMGDWVVAWMDAATSL | (SEQ ID NO: 2556) |
| *DDPKLYDKDLGSAMGDWVVAQVDAAWSL$ | (SEQ ID NO: 2557) |
| *DDPKLYDKDLGSAMGDWVVAQVDAAWSL | (SEQ ID NO: 2558) |
| *DDPKLYDKDLGSAMGDWVVAQVDAATSL$ | (SEQ ID NO: 2559) |
| *DDPKLYDKDLGSAMGDWVVAQVDAATSL | (SEQ ID NO: 2560) |
| *DDPKLYDKDLGSAMGDWVVAQLDAAWSL$ | (SEQ ID NO: 2561) |
| *DDPKLYDKDLGSAMGDWVVAQLDAAWSL | (SEQ ID NO: 2562) |
| *DDPKLYDKDLGSAMGDWVVAQLDAATSL$ | (SEQ ID NO: 2563) |
| *DDPKLYDKDLGSAMGDWVVAQLDAATSL | (SEQ ID NO: 2564) |
| *DDPKLYDKDLGSAMGDWVVAQMDAAWSL$ | (SEQ ID NO: 2565) |

TABLE 3-continued

| Modified Curedoxin-Derived Peptides | |
|---|---|
| *DDPKLYDKDLGSAMGDWVVAQMDAAWSL | (SEQ ID NO: 2566) |
| *DDPKLYDKDLGSAMGDWVVAQMDAATSL$ | (SEQ ID NO: 2567) |
| *DDPKLYDKDLGSAMGDWVVAQMDAATSL | (SEQ ID NO: 2568) |
| *DDPKLYDKDLGSAMGDWVVGWVDAAWSL$ | (SEQ ID NO: 2569) |
| *DDPKLYDKDLGSAMGDWVVGWVDAAWSL | (SEQ ID NO: 2570) |
| *DDPKLYDKDLGSAMGDWVVGWVDAATSL$ | (SEQ ID NO: 2571) |
| *DDPKLYDKDLGSAMGDWVVGWVDAATSL | (SEQ ID NO: 2572) |
| *DDPKLYDKDLGSAMGDWVVGWLDAAWSL$ | (SEQ ID NO: 2573) |
| *DDPKLYDKDLGSAMGDWVVGWLDAAWSL | (SEQ ID NO: 2574) |
| *DDPKLYDKDLGSAMGDWVVGWLDAATSL$ | (SEQ ID NO: 2575) |
| *DDPKLYDKDLGSAMGDWVVGWLDAATSL | (SEQ ID NO: 2576) |
| *DDPKLYDKDLGSAMGDWVVGWMDAAWSL$ | (SEQ ID NO: 2577) |
| *DDPKLYDKDLGSAMGDWVVGWMDAAWSL | (SEQ ID NO: 2578) |
| *DDPKLYDKDLGSAMGDWVVGWMDAATSL$ | (SEQ ID NO: 2579) |
| *DDPKLYDKDLGSAMGDWVVGWMDAATSL | (SEQ ID NO: 2580) |
| *DDPKLYDKDLGSAMGDWVVGQVDAAWSL$ | (SEQ ID NO: 2581) |
| *DDPKLYDKDLGSAMGDWVVGQVDAAWSL | (SEQ ID NO: 2582) |
| *DDPKLYDKDLGSAMGDWVVGQVDAATSL$ | (SEQ ID NO: 2583) |
| *DDPKLYDKDLGSAMGDWVVGQVDAATSL | (SEQ ID NO: 2584) |
| *DDPKLYDKDLGSAMGDWVVGQLDAAWSL$ | (SEQ ID NO: 2585) |
| *DDPKLYDKDLGSAMGDWVVGQLDAAWSL | (SEQ ID NO: 2586) |
| *DDPKLYDKDLGSAMGDWVVGQLDAATSL$ | (SEQ ID NO: 2587) |
| *DDPKLYDKDLGSAMGDWVVGQLDAATSL | (SEQ ID NO: 2588) |
| *DDPKLYDKDLGSAMGDWVVGQMDAAWSL$ | (SEQ ID NO: 2589) |
| *DDPKLYDKDLGSAMGDWVVGQMDAAWSL | (SEQ ID NO: 2590) |
| *DDPKLYDKDLGSAMGDWVVGQMDAATSL$ | (SEQ ID NO: 2591) |
| *DDPKLYDKDLGSAMGDWVVGQMDAATSL | (SEQ ID NO: 2592) |
| *DDPKLYDKDLGSAMGDTVVAWVDAAWSL$ | (SEQ ID NO: 2593) |
| *DDPKLYDKDLGSAMGDTVVAWVDAAWSL | (SEQ ID NO: 2594) |
| *DDPKLYDKDLGSAMGDTVVAWVDAATSL$ | (SEQ ID NO: 2595) |
| *DDPKLYDKDLGSAMGDTVVAWVDAATSL | (SEQ ID NO: 2596) |
| *DDPKLYDKDLGSAMGDTVVAWLDAAWSL$ | (SEQ ID NO: 2597) |
| *DDPKLYDKDLGSAMGDTVVAWLDAAWSL | (SEQ ID NO: 2598) |
| *DDPKLYDKDLGSAMGDTVVAWLDAATSL$ | (SEQ ID NO: 2599) |
| *DDPKLYDKDLGSAMGDTVVAWLDAATSL | (SEQ ID NO: 2600) |
| *DDPKLYDKDLGSAMGDTVVAWMDAAWSL$ | (SEQ ID NO: 2601) |
| *DDPKLYDKDLGSAMGDTVVAWMDAAWSL | (SEQ ID NO: 2602) |
| *DDPKLYDKDLGSAMGDTVVAWMDAATSL$ | (SEQ ID NO: 2603) |
| *DDPKLYDKDLGSAMGDTVVAWMDAATSL | (SEQ ID NO: 2604) |

TABLE 3-continued

| Modified Curedoxin-Derived Peptides | |
|---|---|
| *DDPKLYDKDLGSAMGDTVVAQVDAAWSL$ | (SEQ ID NO: 2605) |
| *DDPKLYDKDLGSAMGDTVVAQVDAAWSL | (SEQ ID NO: 2606) |
| *DDPKLYDKDLGSAMGDTVVAQVDAATSL$ | (SEQ ID NO: 2607) |
| *DDPKLYDKDLGSAMGDTVVAQVDAATSL | (SEQ ID NO: 2608) |
| *DDPKLYDKDLGSAMGDTVVAQLDAAWSL$ | (SEQ ID NO: 2609) |
| *DDPKLYDKDLGSAMGDTVVAQLDAAWSL | (SEQ ID NO: 2610) |
| *DDPKLYDKDLGSAMGDTVVAQLDAATSL$ | (SEQ ID NO: 2611) |
| *DDPKLYDKDLGSAMGDTVVAQLDAATSL | (SEQ ID NO: 2612) |
| *DDPKLYDKDLGSAMGDTVVAQMDAAWSL$ | (SEQ ID NO: 2613) |
| *DDPKLYDKDLGSAMGDTVVAQMDAAWSL | (SEQ ID NO: 2614) |
| *DDPKLYDKDLGSAMGDTVVAQMDAATSL$ | (SEQ ID NO: 2615) |
| *DDPKLYDKDLGSAMGDTVVAQMDAATSL | (SEQ ID NO: 2616) |
| *DDPKLYDKDLGSAMGDTVVGWVDAAWSL$ | (SEQ ID NO: 2617) |
| *DDPKLYDKDLGSAMGDTVVGWVDAAWSL | (SEQ ID NO: 2618) |
| *DDPKLYDKDLGSAMGDTVVGWVDAATSL$ | (SEQ ID NO: 2619) |
| *DDPKLYDKDLGSAMGDTVVGWVDAATSL | (SEQ ID NO: 2620) |
| *DDPKLYDKDLGSAMGDTVVGWLDAAWSL$ | (SEQ ID NO: 2621) |
| *DDPKLYDKDLGSAMGDTVVGWLDAAWSL | (SEQ ID NO: 2622) |
| *DDPKLYDKDLGSAMGDTVVGWLDAATSL$ | (SEQ ID NO: 2623) |
| *DDPKLYDKDLGSAMGDTVVGWLDAATSL | (SEQ ID NO: 2624) |
| *DDPKLYDKDLGSAMGDTVVGWMDAAWSL$ | (SEQ ID NO: 2625) |
| *DDPKLYDKDLGSAMGDTVVGWMDAAWSL | (SEQ ID NO: 2626) |
| *DDPKLYDKDLGSAMGDTVVGWMDAATSL$ | (SEQ ID NO: 2627) |
| *DDPKLYDKDLGSAMGDTVVGWMDAATSL | (SEQ ID NO: 2628) |
| *DDPKLYDKDLGSAMGDTVVGQVDAAWSL$ | (SEQ ID NO: 2629) |
| *DDPKLYDKDLGSAMGDTVVGQVDAAWSL | (SEQ ID NO: 2630) |
| *DDPKLYDKDLGSAMGDTVVGQVDAATSL$ | (SEQ ID NO: 2631) |
| *DDPKLYDKDLGSAMGDTVVGQVDAATSL | (SEQ ID NO: 2632) |
| *DDPKLYDKDLGSAMGDTVVGQLDAAWSL$ | (SEQ ID NO: 2633) |
| *DDPKLYDKDLGSAMGDTVVGQLDAAWSL | (SEQ ID NO: 2634) |
| *DDPKLYDKDLGSAMGDTVVGQLDAATSL$ | (SEQ ID NO: 2635) |
| *DDPKLYDKDLGSAMGDTVVGQLDAATSL | (SEQ ID NO: 2636) |
| *DDPKLYDKDLGSAMGDTVVGQMDAAWSL$ | (SEQ ID NO: 2637) |
| *DDPKLYDKDLGSAMGDTVVGQMDAAWSL | (SEQ ID NO: 2638) |
| *DDPKLYDKDLGSAMGDTVVGQMDAATSL$ | (SEQ ID NO: 2639) |
| *DDPKLYDKDLGSAMGDTVVGQMDAATSL | (SEQ ID NO: 2640) |
| DDPKLYDKDLGSAVWDWVVAWVDAAWSL$ | (SEQ ID NO: 2641) |
| DDPKLYDKDLGSAVWDWVVAWVDAAWSL | (SEQ ID NO: 2642) |
| DDPKLYDKDLGSAVWDWVVAWVDAATSL$ | (SEQ ID NO: 2643) |
| DDPKLYDKDLGSAVWDWVVAWVDAATSL | (SEQ ID NO: 2644) |
| DDPKLYDKDLGSAVWDWVVAWLDAAWSL$ | (SEQ ID NO: 2645) |
| DDPKLYDKDLGSAVWDWVVAWLDAAWSL | (SEQ ID NO: 2646) |
| DDPKLYDKDLGSAVWDWVVAWLDAATSL$ | (SEQ ID NO: 2647) |
| DDPKLYDKDLGSAVWDWVVAWLDAATSL | (SEQ ID NO: 2648) |
| DDPKLYDKDLGSAVWDWVVAWMDAAWSL$ | (SEQ ID NO: 2649) |
| DDPKLYDKDLGSAVWDWVVAWMDAAWSL | (SEQ ID NO: 2650) |
| DDPKLYDKDLGSAVWDWVVAWMDAATSL$ | (SEQ ID NO: 2651) |
| DDPKLYDKDLGSAVWDWVVAWMDAATSL | (SEQ ID NO: 2652) |
| DDPKLYDKDLGSAVWDWVVAQVDAAWSL$ | (SEQ ID NO: 2653) |
| DDPKLYDKDLGSAVWDWVVAQVDAAWSL | (SEQ ID NO: 2654) |
| DDPKLYDKDLGSAVWDWVVAQVDAATSL$ | (SEQ ID NO: 2655) |
| DDPKLYDKDLGSAVWDWVVAQVDAATSL | (SEQ ID NO: 2656) |
| DDPKLYDKDLGSAVWDWVVAQLDAAWSL$ | (SEQ ID NO: 2657) |
| DDPKLYDKDLGSAVWDWVVAQLDAAWSL | (SEQ ID NO: 2658) |
| DDPKLYDKDLGSAVWDWVVAQLDAATSL$ | (SEQ ID NO: 2659) |
| DDPKLYDKDLGSAVWDWVVAQLDAATSL | (SEQ ID NO: 2660) |
| DDPKLYDKDLGSAVWDWVVAQMDAAWSL$ | (SEQ ID NO: 2661) |
| DDPKLYDKDLGSAVWDWVVAQMDAAWSL | (SEQ ID NO: 2662) |
| DDPKLYDKDLGSAVWDWVVAQMDAATSL$ | (SEQ ID NO: 2663) |
| DDPKLYDKDLGSAVWDWVVAQMDAATSL | (SEQ ID NO: 2664) |
| DDPKLYDKDLGSAVWDWVVGWVDAAWSL$ | (SEQ ID NO: 2665) |
| DDPKLYDKDLGSAVWDWVVGWVDAAWSL | (SEQ ID NO: 2666) |
| DDPKLYDKDLGSAVWDWVVGWVDAATSL$ | (SEQ ID NO: 2667) |
| DDPKLYDKDLGSAVWDWVVGWVDAATSL | (SEQ ID NO: 2668) |
| DDPKLYDKDLGSAVWDWVVGWLDAAWSL$ | (SEQ ID NO: 2669) |
| DDPKLYDKDLGSAVWDWVVGWLDAAWSL | (SEQ ID NO: 2670) |
| DDPKLYDKDLGSAVWDWVVGWLDAATSL$ | (SEQ ID NO: 2671) |
| DDPKLYDKDLGSAVWDWVVGWLDAATSL | (SEQ ID NO: 2672) |
| DDPKLYDKDLGSAVWDWVVGWMDAAWSL$ | (SEQ ID NO: 2673) |
| DDPKLYDKDLGSAVWDWVVGWMDAAWSL | (SEQ ID NO: 2674) |
| DDPKLYDKDLGSAVWDWVVGWMDAATSL$ | (SEQ ID NO: 2675) |
| DDPKLYDKDLGSAVWDWVVGWMDAATSL | (SEQ ID NO: 2676) |
| DDPKLYDKDLGSAVWDWVVGQVDAAWSL$ | (SEQ ID NO: 2677) |
| DDPKLYDKDLGSAVWDWVVGQVDAAWSL | (SEQ ID NO: 2678) |
| DDPKLYDKDLGSAVWDWVVGQVDAATSL$ | (SEQ ID NO: 2679) |
| DDPKLYDKDLGSAVWDWVVGQVDAATSL | (SEQ ID NO: 2680) |
| DDPKLYDKDLGSAVWDWVVGQLDAAWSL$ | (SEQ ID NO: 2681) |
| DDPKLYDKDLGSAVWDWVVGQLDAAWSL | (SEQ ID NO: 2682) |

TABLE 3-continued

| Modified Curedoxin-Derived Peptides | |
|---|---|
| DDPKLYDKDLGSAVWDWVVGQLDAATSL$ | (SEQ ID NO: 2683) |
| DDPKLYDKDLGSAVWDWVVGQLDAATSL | (SEQ ID NO: 2684) |
| DDPKLYDKDLGSAVWDWVVGQMDAAWSL$ | (SEQ ID NO: 2685) |
| DDPKLYDKDLGSAVWDWVVGQMDAAWSL | (SEQ ID NO: 2686) |
| DDPKLYDKDLGSAVWDWVVGQMDAATSL$ | (SEQ ID NO: 2687) |
| DDPKLYDKDLGSAVWDWVVGQMDAATSL | (SEQ ID NO: 2688) |
| DDPKLYDKDLGSAVWDTVVAWVDAAWSL$ | (SEQ ID NO: 2689) |
| DDPKLYDKDLGSAVWDTVVAWVDAAWSL | (SEQ ID NO: 2690) |
| DDPKLYDKDLGSAVWDTVVAWVDAATSL$ | (SEQ ID NO: 2691) |
| DDPKLYDKDLGSAVWDTVVAWVDAATSL | (SEQ ID NO: 2692) |
| DDPKLYDKDLGSAVWDTVVAWLDAAWSL$ | (SEQ ID NO: 2693) |
| DDPKLYDKDLGSAVWDTVVAWLDAAWSL | (SEQ ID NO: 2694) |
| DDPKLYDKDLGSAVWDTVVAWLDAATSL$ | (SEQ ID NO: 2695) |
| DDPKLYDKDLGSAVWDTVVAWLDAATSL | (SEQ ID NO: 2696) |
| DDPKLYDKDLGSAVWDTVVAWMDAAWSL$ | (SEQ ID NO: 2697) |
| DDPKLYDKDLGSAVWDTVVAWMDAAWSL | (SEQ ID NO: 2698) |
| DDPKLYDKDLGSAVWDTVVAWMDAATSL$ | (SEQ ID NO: 2699) |
| DDPKLYDKDLGSAVWDTVVAWMDAATSL | (SEQ ID NO: 2700) |
| DDPKLYDKDLGSAVWDTVVAQVDAAWSL$ | (SEQ ID NO: 2701) |
| DDPKLYDKDLGSAVWDTVVAQVDAAWSL | (SEQ ID NO: 2702) |
| DDPKLYDKDLGSAVWDTVVAQVDAATSL$ | (SEQ ID NO: 2703) |
| DDPKLYDKDLGSAVWDTVVAQVDAATSL | (SEQ ID NO: 2704) |
| DDPKLYDKDLGSAVWDTVVAQLDAAWSL$ | (SEQ ID NO: 2705) |
| DDPKLYDKDLGSAVWDTVVAQLDAAWSL | (SEQ ID NO: 2706) |
| DDPKLYDKDLGSAVWDTVVAQLDAATSL$ | (SEQ ID NO: 2707) |
| DDPKLYDKDLGSAVWDTVVAQLDAATSL | (SEQ ID NO: 2708) |
| DDPKLYDKDLGSAVWDTVVAQMDAAWSL$ | (SEQ ID NO: 2709) |
| DDPKLYDKDLGSAVWDTVVAQMDAAWSL | (SEQ ID NO: 2710) |
| DDPKLYDKDLGSAVWDTVVAQMDAATSL$ | (SEQ ID NO: 2711) |
| DDPKLYDKDLGSAVWDTVVAQMDAATSL | (SEQ ID NO: 2712) |
| DDPKLYDKDLGSAVWDTVVGWVDAAWSL$ | (SEQ ID NO: 2713) |
| DDPKLYDKDLGSAVWDTVVGWVDAAWSL | (SEQ ID NO: 2714) |
| DDPKLYDKDLGSAVWDTVVGWVDAATSL$ | (SEQ ID NO: 2715) |
| DDPKLYDKDLGSAVWDTVVGWVDAATSL | (SEQ ID NO: 2716) |
| DDPKLYDKDLGSAVWDTVVGWLDAAWSL$ | (SEQ ID NO: 2717) |
| DDPKLYDKDLGSAVWDTVVGWLDAAWSL | (SEQ ID NO: 2718) |
| DDPKLYDKDLGSAVWDTVVGWLDAATSL$ | (SEQ ID NO: 2719) |
| DDPKLYDKDLGSAVWDTVVGWLDAATSL | (SEQ ID NO: 2720) |
| DDPKLYDKDLGSAVWDTVVGWMDAAWSL$ | (SEQ ID NO: 2721) |

TABLE 3-continued

| Modified Curedoxin-Derived Peptides | |
|---|---|
| DDPKLYDKDLGSAVWDTVVGWMDAAWSL | (SEQ ID NO: 2722) |
| DDPKLYDKDLGSAVWDTVVGWMDAATSL$ | (SEQ ID NO: 2723) |
| DDPKLYDKDLGSAVWDTVVGWMDAATSL | (SEQ ID NO: 2724) |
| DDPKLYDKDLGSAVWDTVVGQVDAAWSL$ | (SEQ ID NO: 2725) |
| DDPKLYDKDLGSAVWDTVVGQVDAAWSL | (SEQ ID NO: 2726) |
| DDPKLYDKDLGSAVWDTVVGQVDAATSL$ | (SEQ ID NO: 2727) |
| DDPKLYDKDLGSAVWDTVVGQVDAATSL | (SEQ ID NO: 2728) |
| DDPKLYDKDLGSAVWDTVVGQLDAAWSL$ | (SEQ ID NO: 2729) |
| DDPKLYDKDLGSAVWDTVVGQLDAAWSL | (SEQ ID NO: 2730) |
| DDPKLYDKDLGSAVWDTVVGQLDAATSL$ | (SEQ ID NO: 2731) |
| DDPKLYDKDLGSAVWDTVVGQLDAATSL | (SEQ ID NO: 2732) |
| DDPKLYDKDLGSAVWDTVVGQMDAAWSL$ | (SEQ ID NO: 2733) |
| DDPKLYDKDLGSAVWDTVVGQMDAAWSL | (SEQ ID NO: 2734) |
| DDPKLYDKDLGSAVWDTVVGQMDAATSL$ | (SEQ ID NO: 2735) |
| DDPKLYDKDLGSAVWDTVVGQMDAATSL | (SEQ ID NO: 2736) |
| DDPKLYDKDLGSAVTDWVVAWVDAAWSL$ | (SEQ ID NO: 2737) |
| DDPKLYDKDLGSAVTDWVVAWVDAAWSL | (SEQ ID NO: 2738) |
| DDPKLYDKDLGSAVTDWVVAWVDAATSL$ | (SEQ ID NO: 2739) |
| DDPKLYDKDLGSAVTDWVVAWVDAATSL | (SEQ ID NO: 2740) |
| DDPKLYDKDLGSAVTDWVVAWLDAAWSL$ | (SEQ ID NO: 2741) |
| DDPKLYDKDLGSAVTDWVVAWLDAAWSL | (SEQ ID NO: 2742) |
| DDPKLYDKDLGSAVTDWVVAWLDAATSL$ | (SEQ ID NO: 2743) |
| DDPKLYDKDLGSAVTDWVVAWLDAATSL | (SEQ ID NO: 2744) |
| DDPKLYDKDLGSAVTDWVVAWMDAAWSL$ | (SEQ ID NO: 2745) |
| DDPKLYDKDLGSAVTDWVVAWMDAAWSL | (SEQ ID NO: 2746) |
| DDPKLYDKDLGSAVTDWVVAWMDAATSL$ | (SEQ ID NO: 2747) |
| DDPKLYDKDLGSAVTDWVVAWMDAATSL | (SEQ ID NO: 2748) |
| DDPKLYDKDLGSAVTDWVVAQVDAAWSL$ | (SEQ ID NO: 2749) |
| DDPKLYDKDLGSAVTDWVVAQVDAAWSL | (SEQ ID NO: 2750) |
| DDPKLYDKDLGSAVTDWVVAQVDAATSL$ | (SEQ ID NO: 2751) |
| DDPKLYDKDLGSAVTDWVVAQVDAATSL | (SEQ ID NO: 2752) |
| DDPKLYDKDLGSAVTDWVVAQLDAAWSL$ | (SEQ ID NO: 2753) |
| DDPKLYDKDLGSAVTDWVVAQLDAAWSL | (SEQ ID NO: 2754) |
| DDPKLYDKDLGSAVTDWVVAQLDAATSL$ | (SEQ ID NO: 2755) |
| DDPKLYDKDLGSAVTDWVVAQLDAATSL | (SEQ ID NO: 2756) |
| DDPKLYDKDLGSAVTDWVVAQMDAAWSL$ | (SEQ ID NO: 2757) |
| DDPKLYDKDLGSAVTDWVVAQMDAAWSL | (SEQ ID NO: 2758) |
| DDPKLYDKDLGSAVTDWVVAQMDAATSL$ | (SEQ ID NO: 2759) |
| DDPKLYDKDLGSAVTDWVVAQMDAATSL | (SEQ ID NO: 2760) |

TABLE 3-continued

| Modified Curedoxin-Derived Peptides | |
|---|---|
| DDPKLYDKDLGSAVTDWVVGWVDAAWSL$ | (SEQ ID NO: 2761) |
| DDPKLYDKDLGSAVTDWVVGWVDAAWSL | (SEQ ID NO: 2762) |
| DDPKLYDKDLGSAVTDWVVGWVDAATSL$ | (SEQ ID NO: 2763) |
| DDPKLYDKDLGSAVTDWVVGWVDAATSL | (SEQ ID NO: 2764) |
| DDPKLYDKDLGSAVTDWVVGWLDAAWSL$ | (SEQ ID NO: 2765) |
| DDPKLYDKDLGSAVTDWVVGWLDAAWSL | (SEQ ID NO: 2766) |
| DDPKLYDKDLGSAVTDWVVGWLDAATSL$ | (SEQ ID NO: 2767) |
| DDPKLYDKDLGSAVTDWVVGWLDAATSL | (SEQ ID NO: 2768) |
| DDPKLYDKDLGSAVTDWVVGWMDAAWSL$ | (SEQ ID NO: 2769) |
| DDPKLYDKDLGSAVTDWVVGWMDAAWSL | (SEQ ID NO: 2770) |
| DDPKLYDKDLGSAVTDWVVGWMDAATSL$ | (SEQ ID NO: 2771) |
| DDPKLYDKDLGSAVTDWVVGWMDAATSL | (SEQ ID NO: 2772) |
| DDPKLYDKDLGSAVTDWVVGQVDAAWSL$ | (SEQ ID NO: 2773) |
| DDPKLYDKDLGSAVTDWVVGQVDAAWSL | (SEQ ID NO: 2774) |
| DDPKLYDKDLGSAVTDWVVGQVDAATSL$ | (SEQ ID NO: 2775) |
| DDPKLYDKDLGSAVTDWVVGQVDAATSL | (SEQ ID NO: 2776) |
| DDPKLYDKDLGSAVTDWVVGQLDAAWSL$ | (SEQ ID NO: 2777) |
| DDPKLYDKDLGSAVTDWVVGQLDAAWSL | (SEQ ID NO: 2778) |
| DDPKLYDKDLGSAVTDWVVGQLDAATSL$ | (SEQ ID NO: 2779) |
| DDPKLYDKDLGSAVTDWVVGQLDAATSL | (SEQ ID NO: 2780) |
| DDPKLYDKDLGSAVTDWVVGQMDAAWSL$ | (SEQ ID NO: 2781) |
| DDPKLYDKDLGSAVTDWVVGQMDAAWSL | (SEQ ID NO: 2782) |
| DDPKLYDKDLGSAVTDWVVGQMDAATSL$ | (SEQ ID NO: 2783) |
| DDPKLYDKDLGSAVTDWVVGQMDAATSL | (SEQ ID NO: 2784) |
| DDPKLYDKDLGSAVTDTVVAWVDAAWSL$ | (SEQ ID NO: 2785) |
| DDPKLYDKDLGSAVTDTVVAWVDAAWSL | (SEQ ID NO: 2786) |
| DDPKLYDKDLGSAVTDTVVAWVDAATSL$ | (SEQ ID NO: 2787) |
| DDPKLYDKDLGSAVTDTVVAWVDAATSL | (SEQ ID NO: 2788) |
| DDPKLYDKDLGSAVTDTVVAWLDAAWSL$ | (SEQ ID NO: 2789) |
| DDPKLYDKDLGSAVTDTVVAWLDAAWSL | (SEQ ID NO: 2790) |
| DDPKLYDKDLGSAVTDTVVAWLDAATSL$ | (SEQ ID NO: 2791) |
| DDPKLYDKDLGSAVTDTVVAWLDAATSL | (SEQ ID NO: 2792) |
| DDPKLYDKDLGSAVTDTVVAWMDAAWSL$ | (SEQ ID NO: 2793) |
| DDPKLYDKDLGSAVTDTVVAWMDAAWSL | (SEQ ID NO: 2794) |
| DDPKLYDKDLGSAVTDTVVAWMDAATSL$ | (SEQ ID NO: 2795) |
| DDPKLYDKDLGSAVTDTVVAWMDAATSL | (SEQ ID NO: 2796) |
| DDPKLYDKDLGSAVTDTVVAQVDAAWSL$ | (SEQ ID NO: 2797) |
| DDPKLYDKDLGSAVTDTVVAQVDAAWSL | (SEQ ID NO: 2798) |
| DDPKLYDKDLGSAVTDTVVAQVDAATSL$ | (SEQ ID NO: 2799) |

TABLE 3-continued

| Modified Curedoxin-Derived Peptides | |
|---|---|
| DDPKLYDKDLGSAVTDTVVAQVDAATSL | (SEQ ID NO: 2800) |
| DDPKLYDKDLGSAVTDTVVAQLDAAWSL$ | (SEQ ID NO: 2801) |
| DDPKLYDKDLGSAVTDTVVAQLDAAWSL | (SEQ ID NO: 2802) |
| DDPKLYDKDLGSAVTDTVVAQLDAATSL$ | (SEQ ID NO: 2803) |
| DDPKLYDKDLGSAVTDTVVAQLDAATSL | (SEQ ID NO: 2804) |
| DDPKLYDKDLGSAVTDTVVAQMDAAWSL$ | (SEQ ID NO: 2805) |
| DDPKLYDKDLGSAVTDTVVAQMDAAWSL | (SEQ ID NO: 2806) |
| DDPKLYDKDLGSAVTDTVVAQMDAATSL$ | (SEQ ID NO: 2807) |
| DDPKLYDKDLGSAVTDTVVAQMDAATSL | (SEQ ID NO: 2808) |
| DDPKLYDKDLGSAVTDTVVGWVDAAWSL$ | (SEQ ID NO: 2809) |
| DDPKLYDKDLGSAVTDTVVGWVDAAWSL | (SEQ ID NO: 2810) |
| DDPKLYDKDLGSAVTDTVVGWVDAATSL$ | (SEQ ID NO: 2811) |
| DDPKLYDKDLGSAVTDTVVGWVDAATSL | (SEQ ID NO: 2812) |
| DDPKLYDKDLGSAVTDTVVGWLDAAWSL$ | (SEQ ID NO: 2813) |
| DDPKLYDKDLGSAVTDTVVGWLDAAWSL | (SEQ ID NO: 2814) |
| DDPKLYDKDLGSAVTDTVVGWLDAATSL$ | (SEQ ID NO: 2815) |
| DDPKLYDKDLGSAVTDTVVGWLDAATSL | (SEQ ID NO: 2816) |
| DDPKLYDKDLGSAVTDTVVGWMDAAWSL$ | (SEQ ID NO: 2817) |
| DDPKLYDKDLGSAVTDTVVGWMDAAWSL | (SEQ ID NO: 2818) |
| DDPKLYDKDLGSAVTDTVVGWMDAATSL$ | (SEQ ID NO: 2819) |
| DDPKLYDKDLGSAVTDTVVGWMDAATSL | (SEQ ID NO: 2820) |
| DDPKLYDKDLGSAVTDTVVGQVDAAWSL$ | (SEQ ID NO: 2821) |
| DDPKLYDKDLGSAVTDTVVGQVDAAWSL | (SEQ ID NO: 2822) |
| DDPKLYDKDLGSAVTDTVVGQVDAATSL$ | (SEQ ID NO: 2823) |
| DDPKLYDKDLGSAVTDTVVGQVDAATSL | (SEQ ID NO: 2824) |
| DDPKLYDKDLGSAVTDTVVGQLDAAWSL$ | (SEQ ID NO: 2825) |
| DDPKLYDKDLGSAVTDTVVGQLDAAWSL | (SEQ ID NO: 2826) |
| DDPKLYDKDLGSAVTDTVVGQLDAATSL$ | (SEQ ID NO: 2827) |
| DDPKLYDKDLGSAVTDTVVGQLDAATSL | (SEQ ID NO: 2828) |
| DDPKLYDKDLGSAVTDTVVGQMDAAWSL$ | (SEQ ID NO: 2829) |
| DDPKLYDKDLGSAVTDTVVGQMDAAWSL | (SEQ ID NO: 2830) |
| DDPKLYDKDLGSAVTDTVVGQMDAATSL$ | (SEQ ID NO: 2831) |
| DDPKLYDKDLGSAVTDTVVGQMDAATSL | (SEQ ID NO: 2832) |
| DDPKLYDKDLGSAVGDWVVAWVDAAWSL$ | (SEQ ID NO: 2833) |
| DDPKLYDKDLGSAVGDWVVAWVDAAWSL | (SEQ ID NO: 2834) |
| DDPKLYDKDLGSAVGDWVVAWVDAATSL$ | (SEQ ID NO: 2835) |
| DDPKLYDKDLGSAVGDWVVAWVDAATSL | (SEQ ID NO: 2836) |
| DDPKLYDKDLGSAVGDWVVAWLDAAWSL$ | (SEQ ID NO: 2837) |
| DDPKLYDKDLGSAVGDWVVAWLDAAWSL | (SEQ ID NO: 2838) |

TABLE 3-continued

| Modified Curedoxin-Derived Peptides | |
|---|---|
| DDPKLYDKDLGSAVGDWVVAWLDAATSL$ | (SEQ ID NO: 2839) |
| DDPKLYDKDLGSAVGDWVVAWLDAATSL | (SEQ ID NO: 2840) |
| DDPKLYDKDLGSAVGDWVVAWMDAAWSL$ | (SEQ ID NO: 2841) |
| DDPKLYDKDLGSAVGDWVVAWMDAAWSL | (SEQ ID NO: 2842) |
| DDPKLYDKDLGSAVGDWVVAWMDAATSL$ | (SEQ ID NO: 2843) |
| DDPKLYDKDLGSAVGDWVVAWMDAATSL | (SEQ ID NO: 2844) |
| DDPKLYDKDLGSAVGDWVVAQVDAAWSL$ | (SEQ ID NO: 2845) |
| DDPKLYDKDLGSAVGDWVVAQVDAAWSL | (SEQ ID NO: 2846) |
| DDPKLYDKDLGSAVGDWVVAQVDAATSL$ | (SEQ ID NO: 2847) |
| DDPKLYDKDLGSAVGDWVVAQVDAATSL | (SEQ ID NO: 2848) |
| DDPKLYDKDLGSAVGDWVVAQLDAAWSL$ | (SEQ ID NO: 2849) |
| DDPKLYDKDLGSAVGDWVVAQLDAAWSL | (SEQ ID NO: 2850) |
| DDPKLYDKDLGSAVGDWVVAQLDAATSL$ | (SEQ ID NO: 2851) |
| DDPKLYDKDLGSAVGDWVVAQLDAATSL | (SEQ ID NO: 2852) |
| DDPKLYDKDLGSAVGDWVVAQMDAAWSL$ | (SEQ ID NO: 2853) |
| DDPKLYDKDLGSAVGDWVVAQMDAAWSL | (SEQ ID NO: 2854) |
| DDPKLYDKDLGSAVGDWVVAQMDAATSL$ | (SEQ ID NO: 2855) |
| DDPKLYDKDLGSAVGDWVVAQMDAATSL | (SEQ ID NO: 2856) |
| DDPKLYDKDLGSAVGDWVVGWVDAAWSL$ | (SEQ ID NO: 2857) |
| DDPKLYDKDLGSAVGDWVVGWVDAAWSL | (SEQ ID NO: 2858) |
| DDPKLYDKDLGSAVGDWVVGWVDAATSL$ | (SEQ ID NO: 2859) |
| DDPKLYDKDLGSAVGDWVVGWVDAATSL | (SEQ ID NO: 2860) |
| DDPKLYDKDLGSAVGDWVVGWLDAAWSL$ | (SEQ ID NO: 2861) |
| DDPKLYDKDLGSAVGDWVVGWLDAAWSL | (SEQ ID NO: 2862) |
| DDPKLYDKDLGSAVGDWVVGWLDAATSL$ | (SEQ ID NO: 2863) |
| DDPKLYDKDLGSAVGDWVVGWLDAATSL | (SEQ ID NO: 2864) |
| DDPKLYDKDLGSAVGDWVVGWMDAAWSL$ | (SEQ ID NO: 2865) |
| DDPKLYDKDLGSAVGDWVVGWMDAAWSL | (SEQ ID NO: 2866) |
| DDPKLYDKDLGSAVGDWVVGWMDAATSL$ | (SEQ ID NO: 2867) |
| DDPKLYDKDLGSAVGDWVVGWMDAATSL | (SEQ ID NO: 2868) |
| DDPKLYDKDLGSAVGDWVVGQVDAAWSL$ | (SEQ ID NO: 2869) |
| DDPKLYDKDLGSAVGDWVVGQVDAAWSL | (SEQ ID NO: 2870) |
| DDPKLYDKDLGSAVGDWVVGQVDAATSL$ | (SEQ ID NO: 2871) |
| DDPKLYDKDLGSAVGDWVVGQVDAATSL | (SEQ ID NO: 2872) |
| DDPKLYDKDLGSAVGDWVVGQLDAAWSL$ | (SEQ ID NO: 2873) |
| DDPKLYDKDLGSAVGDWVVGQLDAAWSL | (SEQ ID NO: 2874) |
| DDPKLYDKDLGSAVGDWVVGQLDAATSL$ | (SEQ ID NO: 2875) |
| DDPKLYDKDLGSAVGDWVVGQLDAATSL | (SEQ ID NO: 2876) |
| DDPKLYDKDLGSAVGDWVVGQMDAAWSL$ | (SEQ ID NO: 2877) |

TABLE 3-continued

| Modified Curedoxin-Derived Peptides | |
|---|---|
| DDPKLYDKDLGSAVGDWVVGQMDAAWSL | (SEQ ID NO: 2878) |
| DDPKLYDKDLGSAVGDWVVGQMDAATSL$ | (SEQ ID NO: 2879) |
| DDPKLYDKDLGSAVGDWVVGQMDAATSL | (SEQ ID NO: 2880) |
| DDPKLYDKDLGSAVGDTVVAWVDAAWSL$ | (SEQ ID NO: 2881) |
| DDPKLYDKDLGSAVGDTVVAWVDAAWSL | (SEQ ID NO: 2882) |
| DDPKLYDKDLGSAVGDTVVAWVDAATSL$ | (SEQ ID NO: 2883) |
| DDPKLYDKDLGSAVGDTVVAWVDAATSL | (SEQ ID NO: 2884) |
| DDPKLYDKDLGSAVGDTVVAWLDAAWSL$ | (SEQ ID NO: 2885) |
| DDPKLYDKDLGSAVGDTVVAWLDAAWSL | (SEQ ID NO: 2886) |
| DDPKLYDKDLGSAVGDTVVAWLDAATSL$ | (SEQ ID NO: 2887) |
| DDPKLYDKDLGSAVGDTVVAWLDAATSL | (SEQ ID NO: 2888) |
| DDPKLYDKDLGSAVGDTVVAWMDAAWSL$ | (SEQ ID NO: 2889) |
| DDPKLYDKDLGSAVGDTVVAWMDAAWSL | (SEQ ID NO: 2890) |
| DDPKLYDKDLGSAVGDTVVAWMDAATSL$ | (SEQ ID NO: 2891) |
| DDPKLYDKDLGSAVGDTVVAWMDAATSL | (SEQ ID NO: 2892) |
| DDPKLYDKDLGSAVGDTVVAQVDAAWSL$ | (SEQ ID NO: 2893) |
| DDPKLYDKDLGSAVGDTVVAQVDAAWSL | (SEQ ID NO: 2894) |
| DDPKLYDKDLGSAVGDTVVAQVDAATSL$ | (SEQ ID NO: 2895) |
| DDPKLYDKDLGSAVGDTVVAQVDAATSL | (SEQ ID NO: 2896) |
| DDPKLYDKDLGSAVGDTVVAQLDAAWSL$ | (SEQ ID NO: 2897) |
| DDPKLYDKDLGSAVGDTVVAQLDAAWSL | (SEQ ID NO: 2898) |
| DDPKLYDKDLGSAVGDTVVAQLDAATSL$ | (SEQ ID NO: 2899) |
| DDPKLYDKDLGSAVGDTVVAQLDAATSL | (SEQ ID NO: 2900) |
| DDPKLYDKDLGSAVGDTVVAQMDAAWSL$ | (SEQ ID NO: 2901) |
| DDPKLYDKDLGSAVGDTVVAQMDAAWSL | (SEQ ID NO: 2902) |
| DDPKLYDKDLGSAVGDTVVAQMDAATSL$ | (SEQ ID NO: 2903) |
| DDPKLYDKDLGSAVGDTVVAQMDAATSL | (SEQ ID NO: 2904) |
| DDPKLYDKDLGSAVGDTVVGWVDAAWSL$ | (SEQ ID NO: 2905) |
| DDPKLYDKDLGSAVGDTVVGWVDAAWSL | (SEQ ID NO: 2906) |
| DDPKLYDKDLGSAVGDTVVGWVDAATSL$ | (SEQ ID NO: 2907) |
| DDPKLYDKDLGSAVGDTVVGWVDAATSL | (SEQ ID NO: 2908) |
| DDPKLYDKDLGSAVGDTVVGWLDAAWSL$ | (SEQ ID NO: 2909) |
| DDPKLYDKDLGSAVGDTVVGWLDAAWSL | (SEQ ID NO: 2910) |
| DDPKLYDKDLGSAVGDTVVGWLDAATSL$ | (SEQ ID NO: 2911) |
| DDPKLYDKDLGSAVGDTVVGWLDAATSL | (SEQ ID NO: 2912) |
| DDPKLYDKDLGSAVGDTVVGWMDAAWSL$ | (SEQ ID NO: 2913) |
| DDPKLYDKDLGSAVGDTVVGWMDAAWSL | (SEQ ID NO: 2914) |
| DDPKLYDKDLGSAVGDTVVGWMDAATSL$ | (SEQ ID NO: 2915) |
| DDPKLYDKDLGSAVGDTVVGWMDAATSL | (SEQ ID NO: 2916) |

TABLE 3-continued

| Modified Curedoxin-Derived Peptides | |
|---|---|
| DDPKLYDKDLGSAVGDTVVGQVDAAWSL$ | (SEQ ID NO: 2917) |
| DDPKLYDKDLGSAVGDTVVGQVDAAWSL | (SEQ ID NO: 2918) |
| DDPKLYDKDLGSAVGDTVVGQVDAATSL$ | (SEQ ID NO: 2919) |
| DDPKLYDKDLGSAVGDTVVGQVDAATSL | (SEQ ID NO: 2920) |
| DDPKLYDKDLGSAVGDTVVGQLDAAWSL$ | (SEQ ID NO: 2921) |
| DDPKLYDKDLGSAVGDTVVGQLDAAWSL | (SEQ ID NO: 2922) |
| DDPKLYDKDLGSAVGDTVVGQLDAATSL$ | (SEQ ID NO: 2923) |
| DDPKLYDKDLGSAVGDTVVGQLDAATSL | (SEQ ID NO: 2924) |
| DDPKLYDKDLGSAVGDTVVGQMDAAWSL$ | (SEQ ID NO: 2925) |
| DDPKLYDKDLGSAVGDTVVGQMDAAWSL | (SEQ ID NO: 2926) |
| DDPKLYDKDLGSAVGDTVVGQMDAATSL$ | (SEQ ID NO: 2927) |
| DDPKLYDKDLGSAVGDTVVGQMDAATSL | (SEQ ID NO: 2928) |
| DDPKLYDKDLGSALWDWVVAWVDAAWSL$ | (SEQ ID NO: 2929) |
| DDPKLYDKDLGSALWDWVVAWVDAAWSL | (SEQ ID NO: 2930) |
| DDPKLYDKDLGSALWDWVVAWVDAATSL$ | (SEQ ID NO: 2931) |
| DDPKLYDKDLGSALWDWVVAWVDAATSL | (SEQ ID NO: 2932) |
| DDPKLYDKDLGSALWDWVVAWLDAAWSL$ | (SEQ ID NO: 2933) |
| DDPKLYDKDLGSALWDWVVAWLDAAWSL | (SEQ ID NO: 2934) |
| DDPKLYDKDLGSALWDWVVAWLDAATSL$ | (SEQ ID NO: 2935) |
| DDPKLYDKDLGSALWDWVVAWLDAATSL | (SEQ ID NO: 2936) |
| DDPKLYDKDLGSALWDWVVAWMDAAWSL$ | (SEQ ID NO: 2937) |
| DDPKLYDKDLGSALWDWVVAWMDAAWSL | (SEQ ID NO: 2938) |
| DDPKLYDKDLGSALWDWVVAWMDAATSL$ | (SEQ ID NO: 2939) |
| DDPKLYDKDLGSALWDWVVAWMDAATSL | (SEQ ID NO: 2940) |
| DDPKLYDKDLGSALWDWVVAQVDAAWSL$ | (SEQ ID NO: 2941) |
| DDPKLYDKDLGSALWDWVVAQVDAAWSL | (SEQ ID NO: 2942) |
| DDPKLYDKDLGSALWDWVVAQVDAATSL$ | (SEQ ID NO: 2943) |
| DDPKLYDKDLGSALWDWVVAQVDAATSL | (SEQ ID NO: 2944) |
| DDPKLYDKDLGSALWDWVVAQLDAAWSL$ | (SEQ ID NO: 2945) |
| DDPKLYDKDLGSALWDWVVAQLDAAWSL | (SEQ ID NO: 2946) |
| DDPKLYDKDLGSALWDWVVAQLDAATSL$ | (SEQ ID NO: 2947) |
| DDPKLYDKDLGSALWDWVVAQLDAATSL | (SEQ ID NO: 2948) |
| DDPKLYDKDLGSALWDWVVAQMDAAWSL$ | (SEQ ID NO: 2949) |
| DDPKLYDKDLGSALWDWVVAQMDAAWSL | (SEQ ID NO: 2950) |
| DDPKLYDKDLGSALWDWVVAQMDAATSL$ | (SEQ ID NO: 2951) |
| DDPKLYDKDLGSALWDWVVAQMDAATSL | (SEQ ID NO: 2952) |
| DDPKLYDKDLGSALWDWVVGWVDAAWSL$ | (SEQ ID NO: 2953) |
| DDPKLYDKDLGSALWDWVVGWVDAAWSL | (SEQ ID NO: 2954) |
| DDPKLYDKDLGSALWDWVVGWVDAATSL$ | (SEQ ID NO: 2955) |

TABLE 3-continued

| Modified Curedoxin-Derived Peptides | |
|---|---|
| DDPKLYDKDLGSALWDWVVGWVDAATSL | (SEQ ID NO: 2956) |
| DDPKLYDKDLGSALWDWVVGWLDAAWSL$ | (SEQ ID NO: 2957) |
| DDPKLYDKDLGSALWDWVVGWLDAAWSL | (SEQ ID NO: 2958) |
| DDPKLYDKDLGSALWDWVVGWLDAATSL$ | (SEQ ID NO: 2959) |
| DDPKLYDKDLGSALWDWVVGWLDAATSL | (SEQ ID NO: 2960) |
| DDPKLYDKDLGSALWDWVVGWMDAAWSL$ | (SEQ ID NO: 2961) |
| DDPKLYDKDLGSALWDWVVGWMDAAWSL | (SEQ ID NO: 2962) |
| DDPKLYDKDLGSALWDWVVGWMDAATSL$ | (SEQ ID NO: 2963) |
| DDPKLYDKDLGSALWDWVVGWMDAATSL | (SEQ ID NO: 2964) |
| DDPKLYDKDLGSALWDWVVGQVDAAWSL$ | (SEQ ID NO: 2965) |
| DDPKLYDKDLGSALWDWVVGQVDAAWSL | (SEQ ID NO: 2966) |
| DDPKLYDKDLGSALWDWVVGQVDAATSL$ | (SEQ ID NO: 2967) |
| DDPKLYDKDLGSALWDWVVGQVDAATSL | (SEQ ID NO: 2968) |
| DDPKLYDKDLGSALWDWVVGQLDAAWSL$ | (SEQ ID NO: 2969) |
| DDPKLYDKDLGSALWDWVVGQLDAAWSL | (SEQ ID NO: 2970) |
| DDPKLYDKDLGSALWDWVVGQLDAATSL$ | (SEQ ID NO: 2971) |
| DDPKLYDKDLGSALWDWVVGQLDAATSL | (SEQ ID NO: 2972) |
| DDPKLYDKDLGSALWDWVVGQMDAAWSL$ | (SEQ ID NO: 2973) |
| DDPKLYDKDLGSALWDWVVGQMDAAWSL | (SEQ ID NO: 2974) |
| DDPKLYDKDLGSALWDWVVGQMDAATSL$ | (SEQ ID NO: 2975) |
| DDPKLYDKDLGSALWDWVVGQMDAATSL | (SEQ ID NO: 2976) |
| DDPKLYDKDLGSALWDTVVAWVDAAWSL$ | (SEQ ID NO: 2977) |
| DDPKLYDKDLGSALWDTVVAWVDAAWSL | (SEQ ID NO: 2978) |
| DDPKLYDKDLGSALWDTVVAWVDAATSL$ | (SEQ ID NO: 2979) |
| DDPKLYDKDLGSALWDTVVAWVDAATSL | (SEQ ID NO: 2980) |
| DDPKLYDKDLGSALWDTVVAWLDAAWSL$ | (SEQ ID NO: 2981) |
| DDPKLYDKDLGSALWDTVVAWLDAAWSL | (SEQ ID NO: 2982) |
| DDPKLYDKDLGSALWDTVVAWLDAATSL$ | (SEQ ID NO: 2983) |
| DDPKLYDKDLGSALWDTVVAWLDAATSL | (SEQ ID NO: 2984) |
| DDPKLYDKDLGSALWDTVVAWMDAAWSL$ | (SEQ ID NO: 2985) |
| DDPKLYDKDLGSALWDTVVAWMDAAWSL | (SEQ ID NO: 2986) |
| DDPKLYDKDLGSALWDTVVAWMDAATSL$ | (SEQ ID NO: 2987) |
| DDPKLYDKDLGSALWDTVVAWMDAATSL | (SEQ ID NO: 2988) |
| DDPKLYDKDLGSALWDTVVAQVDAAWSL$ | (SEQ ID NO: 2989) |
| DDPKLYDKDLGSALWDTVVAQVDAAWSL | (SEQ ID NO: 2990) |
| DDPKLYDKDLGSALWDTVVAQVDAATSL$ | (SEQ ID NO: 2991) |
| DDPKLYDKDLGSALWDTVVAQVDAATSL | (SEQ ID NO: 2992) |
| DDPKLYDKDLGSALWDTVVAQLDAAWSL$ | (SEQ ID NO: 2993) |
| DDPKLYDKDLGSALWDTVVAQLDAAWSL | (SEQ ID NO: 2994) |

TABLE 3-continued

| Modified Curedoxin-Derived Peptides | |
|---|---|
| DDPKLYDKDLGSALWDTVVAQLDAATSL$ | (SEQ ID NO: 2995) |
| DDPKLYDKDLGSALWDTVVAQLDAATSL | (SEQ ID NO: 2996) |
| DDPKLYDKDLGSALWDTVVAQMDAAWSL$ | (SEQ ID NO: 2997) |
| DDPKLYDKDLGSALWDTVVAQMDAAWSL | (SEQ ID NO: 2998) |
| DDPKLYDKDLGSALWDTVVAQMDAATSL$ | (SEQ ID NO: 2999) |
| DDPKLYDKDLGSALWDTVVAQMDAATSL | (SEQ ID NO: 3000) |
| DDPKLYDKDLGSALWDTVVGWVDAAWSL$ | (SEQ ID NO: 3001) |
| DDPKLYDKDLGSALWDTVVGWVDAAWSL | (SEQ ID NO: 3002) |
| DDPKLYDKDLGSALWDTVVGWVDAATSL$ | (SEQ ID NO: 3003) |
| DDPKLYDKDLGSALWDTVVGWVDAATSL | (SEQ ID NO: 3004) |
| DDPKLYDKDLGSALWDTVVGWLDAAWSL$ | (SEQ ID NO: 3005) |
| DDPKLYDKDLGSALWDTVVGWLDAAWSL | (SEQ ID NO: 3006) |
| DDPKLYDKDLGSALWDTVVGWLDAATSL$ | (SEQ ID NO: 3007) |
| DDPKLYDKDLGSALWDTVVGWLDAATSL | (SEQ ID NO: 3008) |
| DDPKLYDKDLGSALWDTVVGWMDAAWSL$ | (SEQ ID NO: 3009) |
| DDPKLYDKDLGSALWDTVVGWMDAAWSL | (SEQ ID NO: 3010) |
| DDPKLYDKDLGSALWDTVVGWMDAATSL$ | (SEQ ID NO: 3011) |
| DDPKLYDKDLGSALWDTVVGWMDAATSL | (SEQ ID NO: 3012) |
| DDPKLYDKDLGSALWDTVVGQVDAAWSL$ | (SEQ ID NO: 3013) |
| DDPKLYDKDLGSALWDTVVGQVDAAWSL | (SEQ ID NO: 3014) |
| DDPKLYDKDLGSALWDTVVGQVDAATSL$ | (SEQ ID NO: 3015) |
| DDPKLYDKDLGSALWDTVVGQVDAATSL | (SEQ ID NO: 3016) |
| DDPKLYDKDLGSALWDTVVGQLDAAWSL$ | (SEQ ID NO: 3017) |
| DDPKLYDKDLGSALWDTVVGQLDAAWSL | (SEQ ID NO: 3018) |
| DDPKLYDKDLGSALWDTVVGQLDAATSL$ | (SEQ ID NO: 3019) |
| DDPKLYDKDLGSALWDTVVGQLDAATSL | (SEQ ID NO: 3020) |
| DDPKLYDKDLGSALWDTVVGQMDAAWSL$ | (SEQ ID NO: 3021) |
| DDPKLYDKDLGSALWDTVVGQMDAAWSL | (SEQ ID NO: 3022) |
| DDPKLYDKDLGSALWDTVVGQMDAATSL$ | (SEQ ID NO: 3023) |
| DDPKLYDKDLGSALWDTVVGQMDAATSL | (SEQ ID NO: 3024) |
| DDPKLYDKDLGSALTDWVVAWVDAAWSL$ | (SEQ ID NO: 3025) |
| DDPKLYDKDLGSALTDWVVAWVDAAWSL | (SEQ ID NO: 3026) |
| DDPKLYDKDLGSALTDWVVAWVDAATSL$ | (SEQ ID NO: 3027) |
| DDPKLYDKDLGSALTDWVVAWVDAATSL | (SEQ ID NO: 3028) |
| DDPKLYDKDLGSALTDWVVAWLDAAWSL$ | (SEQ ID NO: 3029) |
| DDPKLYDKDLGSALTDWVVAWLDAAWSL | (SEQ ID NO: 3030) |
| DDPKLYDKDLGSALTDWVVAWLDAATSL$ | (SEQ ID NO: 3031) |
| DDPKLYDKDLGSALTDWVVAWLDAATSL | (SEQ ID NO: 3032) |
| DDPKLYDKDLGSALTDWVVAWMDAAWSL$ | (SEQ ID NO: 3033) |

TABLE 3-continued

| Modified Curedoxin-Derived Peptides | |
|---|---|
| DDPKLYDKDLGSALTDWVVAWMDAAWSL | (SEQ ID NO: 3034) |
| DDPKLYDKDLGSALTDWVVAWMDAATSL$ | (SEQ ID NO: 3035) |
| DDPKLYDKDLGSALTDWVVAWMDAATSL | (SEQ ID NO: 3036) |
| DDPKLYDKDLGSALTDWVVAQVDAAWSL$ | (SEQ ID NO: 3037) |
| DDPKLYDKDLGSALTDWVVAQVDAAWSL | (SEQ ID NO: 3038) |
| DDPKLYDKDLGSALTDWVVAQVDAATSL$ | (SEQ ID NO: 3039) |
| DDPKLYDKDLGSALTDWVVAQVDAATSL | (SEQ ID NO: 3040) |
| DDPKLYDKDLGSALTDWVVAQLDAAWSL$ | (SEQ ID NO: 3041) |
| DDPKLYDKDLGSALTDWVVAQLDAAWSL | (SEQ ID NO: 3042) |
| DDPKLYDKDLGSALTDWVVAQLDAATSL$ | (SEQ ID NO: 3043) |
| DDPKLYDKDLGSALTDWVVAQLDAATSL | (SEQ ID NO: 3044) |
| DDPKLYDKDLGSALTDWVVAQMDAAWSL$ | (SEQ ID NO: 3045) |
| DDPKLYDKDLGSALTDWVVAQMDAAWSL | (SEQ ID NO: 3046) |
| DDPKLYDKDLGSALTDWVVAQMDAATSL$ | (SEQ ID NO: 3047) |
| DDPKLYDKDLGSALTDWVVAQMDAATSL | (SEQ ID NO: 3048) |
| DDPKLYDKDLGSALTDWVVGWVDAAWSL$ | (SEQ ID NO: 3049) |
| DDPKLYDKDLGSALTDWVVGWVDAAWSL | (SEQ ID NO: 3050) |
| DDPKLYDKDLGSALTDWVVGWVDAATSL$ | (SEQ ID NO: 3051) |
| DDPKLYDKDLGSALTDWVVGWVDAATSL | (SEQ ID NO: 3052) |
| DDPKLYDKDLGSALTDWVVGWLDAAWSL$ | (SEQ ID NO: 3053) |
| DDPKLYDKDLGSALTDWVVGWLDAAWSL | (SEQ ID NO: 3054) |
| DDPKLYDKDLGSALTDWVVGWLDAATSL$ | (SEQ ID NO: 3055) |
| DDPKLYDKDLGSALTDWVVGWLDAATSL | (SEQ ID NO: 3056) |
| DDPKLYDKDLGSALTDWVVGWMDAAWSL$ | (SEQ ID NO: 3057) |
| DDPKLYDKDLGSALTDWVVGWMDAAWSL | (SEQ ID NO: 3058) |
| DDPKLYDKDLGSALTDWVVGWMDAATSL$ | (SEQ ID NO: 3059) |
| DDPKLYDKDLGSALTDWVVGWMDAATSL | (SEQ ID NO: 3060) |
| DDPKLYDKDLGSALTDWVVGQVDAAWSL$ | (SEQ ID NO: 3061) |
| DDPKLYDKDLGSALTDWVVGQVDAAWSL | (SEQ ID NO: 3062) |
| DDPKLYDKDLGSALTDWVVGQVDAATSL$ | (SEQ ID NO: 3063) |
| DDPKLYDKDLGSALTDWVVGQVDAATSL | (SEQ ID NO: 3064) |
| DDPKLYDKDLGSALTDWVVGQLDAAWSL$ | (SEQ ID NO: 3065) |
| DDPKLYDKDLGSALTDWVVGQLDAAWSL | (SEQ ID NO: 3066) |
| DDPKLYDKDLGSALTDWVVGQLDAATSL$ | (SEQ ID NO: 3067) |
| DDPKLYDKDLGSALTDWVVGQLDAATSL | (SEQ ID NO: 3068) |
| DDPKLYDKDLGSALTDWVVGQMDAAWSL$ | (SEQ ID NO: 3069) |
| DDPKLYDKDLGSALTDWVVGQMDAAWSL | (SEQ ID NO: 3070) |
| DDPKLYDKDLGSALTDWVVGQMDAATSL$ | (SEQ ID NO: 3071) |
| DDPKLYDKDLGSALTDWVVGQMDAATSL | (SEQ ID NO: 3072) |

TABLE 3-continued

| Modified Curedoxin-Derived Peptides | |
|---|---|
| DDPKLYDKDLGSALTDTVVAWVDAAWSL$ | (SEQ ID NO: 3073) |
| DDPKLYDKDLGSALTDTVVAWVDAAWSL | (SEQ ID NO: 3074) |
| DDPKLYDKDLGSALTDTVVAWVDAATSL$ | (SEQ ID NO: 3075) |
| DDPKLYDKDLGSALTDTVVAWVDAATSL | (SEQ ID NO: 3076) |
| DDPKLYDKDLGSALTDTVVAWLDAAWSL$ | (SEQ ID NO: 3077) |
| DDPKLYDKDLGSALTDTVVAWLDAAWSL | (SEQ ID NO: 3078) |
| DDPKLYDKDLGSALTDTVVAWLDAATSL$ | (SEQ ID NO: 3079) |
| DDPKLYDKDLGSALTDTVVAWLDAATSL | (SEQ ID NO: 3080) |
| DDPKLYDKDLGSALTDTVVAWMDAAWSL$ | (SEQ ID NO: 3081) |
| DDPKLYDKDLGSALTDTVVAWMDAAWSL | (SEQ ID NO: 3082) |
| DDPKLYDKDLGSALTDTVVAWMDAATSL$ | (SEQ ID NO: 3083) |
| DDPKLYDKDLGSALTDTVVAWMDAATSL | (SEQ ID NO: 3084) |
| DDPKLYDKDLGSALTDTVVAQVDAAWSL$ | (SEQ ID NO: 3085) |
| DDPKLYDKDLGSALTDTVVAQVDAAWSL | (SEQ ID NO: 3086) |
| DDPKLYDKDLGSALTDTVVAQVDAATSL$ | (SEQ ID NO: 3087) |
| DDPKLYDKDLGSALTDTVVAQVDAATSL | (SEQ ID NO: 3088) |
| DDPKLYDKDLGSALTDTVVAQLDAAWSL$ | (SEQ ID NO: 3089) |
| DDPKLYDKDLGSALTDTVVAQLDAAWSL | (SEQ ID NO: 3090) |
| DDPKLYDKDLGSALTDTVVAQLDAATSL$ | (SEQ ID NO: 3091) |
| DDPKLYDKDLGSALTDTVVAQLDAATSL | (SEQ ID NO: 3092) |
| DDPKLYDKDLGSALTDTVVAQMDAAWSL$ | (SEQ ID NO: 3093) |
| DDPKLYDKDLGSALTDTVVAQMDAAWSL | (SEQ ID NO: 3094) |
| DDPKLYDKDLGSALTDTVVAQMDAATSL$ | (SEQ ID NO: 3095) |
| DDPKLYDKDLGSALTDTVVAQMDAATSL | (SEQ ID NO: 3096) |
| DDPKLYDKDLGSALTDTVVGWVDAAWSL$ | (SEQ ID NO: 3097) |
| DDPKLYDKDLGSALTDTVVGWVDAAWSL | (SEQ ID NO: 3098) |
| DDPKLYDKDLGSALTDTVVGWVDAATSL$ | (SEQ ID NO: 3099) |
| DDPKLYDKDLGSALTDTVVGWVDAATSL | (SEQ ID NO: 3100) |
| DDPKLYDKDLGSALTDTVVGWLDAAWSL$ | (SEQ ID NO: 3101) |
| DDPKLYDKDLGSALTDTVVGWLDAAWSL | (SEQ ID NO: 3102) |
| DDPKLYDKDLGSALTDTVVGWLDAATSL$ | (SEQ ID NO: 3103) |
| DDPKLYDKDLGSALTDTVVGWLDAATSL | (SEQ ID NO: 3104) |
| DDPKLYDKDLGSALTDTVVGWMDAAWSL$ | (SEQ ID NO: 3105) |
| DDPKLYDKDLGSALTDTVVGWMDAAWSL | (SEQ ID NO: 3106) |
| DDPKLYDKDLGSALTDTVVGWMDAATSL$ | (SEQ ID NO: 3107) |
| DDPKLYDKDLGSALTDTVVGWMDAATSL | (SEQ ID NO: 3108) |
| DDPKLYDKDLGSALTDTVVGQVDAAWSL$ | (SEQ ID NO: 3109) |
| DDPKLYDKDLGSALTDTVVGQVDAAWSL | (SEQ ID NO: 3110) |
| DDPKLYDKDLGSALTDTVVGQVDAATSL$ | (SEQ ID NO: 3111) |

TABLE 3-continued

| Modified Curedoxin-Derived Peptides | |
|---|---|
| DDPKLYDKDLGSALTDTVVGQVDAATSL | (SEQ ID NO: 3112) |
| DDPKLYDKDLGSALTDTVVGQLDAAWSL$ | (SEQ ID NO: 3113) |
| DDPKLYDKDLGSALTDTVVGQLDAAWSL | (SEQ ID NO: 3114) |
| DDPKLYDKDLGSALTDTVVGQLDAATSL$ | (SEQ ID NO: 3115) |
| DDPKLYDKDLGSALTDTVVGQLDAATSL | (SEQ ID NO: 3116) |
| DDPKLYDKDLGSALTDTVVGQMDAAWSL$ | (SEQ ID NO: 3117) |
| DDPKLYDKDLGSALTDTVVGQMDAAWSL | (SEQ ID NO: 3118) |
| DDPKLYDKDLGSALTDTVVGQMDAATSL$ | (SEQ ID NO: 3119) |
| DDPKLYDKDLGSALTDTVVGQMDAATSL | (SEQ ID NO: 3120) |
| DDPKLYDKDLGSALGDWVVAWVDAAWSL$ | (SEQ ID NO: 3121) |
| DDPKLYDKDLGSALGDWVVAWVDAAWSL | (SEQ ID NO: 3122) |
| DDPKLYDKDLGSALGDWVVAWVDAATSL$ | (SEQ ID NO: 3123) |
| DDPKLYDKDLGSALGDWVVAWVDAATSL | (SEQ ID NO: 3124) |
| DDPKLYDKDLGSALGDWVVAWLDAAWSL$ | (SEQ ID NO: 3125) |
| DDPKLYDKDLGSALGDWVVAWLDAAWSL | (SEQ ID NO: 3126) |
| DDPKLYDKDLGSALGDWVVAWLDAATSL$ | (SEQ ID NO: 3127) |
| DDPKLYDKDLGSALGDWVVAWLDAATSL | (SEQ ID NO: 3128) |
| DDPKLYDKDLGSALGDWVVAWMDAAWSL$ | (SEQ ID NO: 3129) |
| DDPKLYDKDLGSALGDWVVAWMDAAWSL | (SEQ ID NO: 3130) |
| DDPKLYDKDLGSALGDWVVAWMDAATSL$ | (SEQ ID NO: 3131) |
| DDPKLYDKDLGSALGDWVVAWMDAATSL | (SEQ ID NO: 3132) |
| DDPKLYDKDLGSALGDWVVAQVDAAWSL$ | (SEQ ID NO: 3133) |
| DDPKLYDKDLGSALGDWVVAQVDAAWSL | (SEQ ID NO: 3134) |
| DDPKLYDKDLGSALGDWVVAQVDAATSL$ | (SEQ ID NO: 3135) |
| DDPKLYDKDLGSALGDWVVAQVDAATSL | (SEQ ID NO: 3136) |
| DDPKLYDKDLGSALGDWVVAQLDAAWSL$ | (SEQ ID NO: 3137) |
| DDPKLYDKDLGSALGDWVVAQLDAAWSL | (SEQ ID NO: 3138) |
| DDPKLYDKDLGSALGDWVVAQLDAATSL$ | (SEQ ID NO: 3139) |
| DDPKLYDKDLGSALGDWVVAQLDAATSL | (SEQ ID NO: 3140) |
| DDPKLYDKDLGSALGDWVVAQMDAAWSL$ | (SEQ ID NO: 3141) |
| DDPKLYDKDLGSALGDWVVAQMDAAWSL | (SEQ ID NO: 3142) |
| DDPKLYDKDLGSALGDWVVAQMDAATSL$ | (SEQ ID NO: 3143) |
| DDPKLYDKDLGSALGDWVVAQMDAATSL | (SEQ ID NO: 3144) |
| DDPKLYDKDLGSALGDWVVGWVDAAWSL$ | (SEQ ID NO: 3145) |
| DDPKLYDKDLGSALGDWVVGWVDAAWSL | (SEQ ID NO: 3146) |
| DDPKLYDKDLGSALGDWVVGWVDAATSL$ | (SEQ ID NO: 3147) |
| DDPKLYDKDLGSALGDWVVGWVDAATSL | (SEQ ID NO: 3148) |
| DDPKLYDKDLGSALGDWVVGWLDAAWSL$ | (SEQ ID NO: 3149) |
| DDPKLYDKDLGSALGDWVVGWLDAAWSL | (SEQ ID NO: 3150) |

TABLE 3-continued

| Modified Curedoxin-Derived Peptides | |
|---|---|
| DDPKLYDKDLGSALGDWVVGWLDAATSL$ | (SEQ ID NO: 3151) |
| DDPKLYDKDLGSALGDWVVGWLDAATSL | (SEQ ID NO: 3152) |
| DDPKLYDKDLGSALGDWVVGWMDAAWSL$ | (SEQ ID NO: 3153) |
| DDPKLYDKDLGSALGDWVVGWMDAAWSL | (SEQ ID NO: 3154) |
| DDPKLYDKDLGSALGDWVVGWMDAATSL$ | (SEQ ID NO: 3155) |
| DDPKLYDKDLGSALGDWVVGWMDAATSL | (SEQ ID NO: 3156) |
| DDPKLYDKDLGSALGDWVVGQVDAAWSL$ | (SEQ ID NO: 3157) |
| DDPKLYDKDLGSALGDWVVGQVDAAWSL | (SEQ ID NO: 3158) |
| DDPKLYDKDLGSALGDWVVGQVDAATSL$ | (SEQ ID NO: 3159) |
| DDPKLYDKDLGSALGDWVVGQVDAATSL | (SEQ ID NO: 3160) |
| DDPKLYDKDLGSALGDWVVGQLDAAWSL$ | (SEQ ID NO: 3161) |
| DDPKLYDKDLGSALGDWVVGQLDAAWSL | (SEQ ID NO: 3162) |
| DDPKLYDKDLGSALGDWVVGQLDAATSL$ | (SEQ ID NO: 3163) |
| DDPKLYDKDLGSALGDWVVGQLDAATSL | (SEQ ID NO: 3164) |
| DDPKLYDKDLGSALGDWVVGQMDAAWSL$ | (SEQ ID NO: 3165) |
| DDPKLYDKDLGSALGDWVVGQMDAAWSL | (SEQ ID NO: 3166) |
| DDPKLYDKDLGSALGDWVVGQMDAATSL$ | (SEQ ID NO: 3167) |
| DDPKLYDKDLGSALGDWVVGQMDAATSL | (SEQ ID NO: 3168) |
| DDPKLYDKDLGSALGDTVVAWVDAAWSL$ | (SEQ ID NO: 3169) |
| DDPKLYDKDLGSALGDTVVAWVDAAWSL | (SEQ ID NO: 3170) |
| DDPKLYDKDLGSALGDTVVAWVDAATSL$ | (SEQ ID NO: 3171) |
| DDPKLYDKDLGSALGDTVVAWVDAATSL | (SEQ ID NO: 3172) |
| DDPKLYDKDLGSALGDTVVAWLDAAWSL$ | (SEQ ID NO: 3173) |
| DDPKLYDKDLGSALGDTVVAWLDAAWSL | (SEQ ID NO: 3174) |
| DDPKLYDKDLGSALGDTVVAWLDAATSL$ | (SEQ ID NO: 3175) |
| DDPKLYDKDLGSALGDTVVAWLDAATSL | (SEQ ID NO: 3176) |
| DDPKLYDKDLGSALGDTVVAWMDAAWSL$ | (SEQ ID NO: 3177) |
| DDPKLYDKDLGSALGDTVVAWMDAAWSL | (SEQ ID NO: 3178) |
| DDPKLYDKDLGSALGDTVVAWMDAATSL$ | (SEQ ID NO: 3179) |
| DDPKLYDKDLGSALGDTVVAWMDAATSL | (SEQ ID NO: 3180) |
| DDPKLYDKDLGSALGDTVVAQVDAAWSL$ | (SEQ ID NO: 3181) |
| DDPKLYDKDLGSALGDTVVAQVDAAWSL | (SEQ ID NO: 3182) |
| DDPKLYDKDLGSALGDTVVAQVDAATSL$ | (SEQ ID NO: 3183) |
| DDPKLYDKDLGSALGDTVVAQVDAATSL | (SEQ ID NO: 3184) |
| DDPKLYDKDLGSALGDTVVAQLDAAWSL$ | (SEQ ID NO: 3185) |
| DDPKLYDKDLGSALGDTVVAQLDAAWSL | (SEQ ID NO: 3186) |
| DDPKLYDKDLGSALGDTVVAQLDAATSL$ | (SEQ ID NO: 3187) |
| DDPKLYDKDLGSALGDTVVAQLDAATSL | (SEQ ID NO: 3188) |
| DDPKLYDKDLGSALGDTVVAQMDAAWSL$ | (SEQ ID NO: 3189) |
| DDPKLYDKDLGSALGDTVVAQMDAAWSL | (SEQ ID NO: 3190) |
| DDPKLYDKDLGSALGDTVVAQMDAATSL$ | (SEQ ID NO: 3191) |
| DDPKLYDKDLGSALGDTVVAQMDAATSL | (SEQ ID NO: 3192) |
| DDPKLYDKDLGSALGDTVVGWVDAAWSL$ | (SEQ ID NO: 3193) |
| DDPKLYDKDLGSALGDTVVGWVDAAWSL | (SEQ ID NO: 3194) |
| DDPKLYDKDLGSALGDTVVGWVDAATSL$ | (SEQ ID NO: 3195) |
| DDPKLYDKDLGSALGDTVVGWVDAATSL | (SEQ ID NO: 3196) |
| DDPKLYDKDLGSALGDTVVGWLDAAWSL$ | (SEQ ID NO: 3197) |
| DDPKLYDKDLGSALGDTVVGWLDAAWSL | (SEQ ID NO: 3198) |
| DDPKLYDKDLGSALGDTVVGWLDAATSL$ | (SEQ ID NO: 3199) |
| DDPKLYDKDLGSALGDTVVGWLDAATSL | (SEQ ID NO: 3200) |
| DDPKLYDKDLGSALGDTVVGWMDAAWSL$ | (SEQ ID NO: 3201) |
| DDPKLYDKDLGSALGDTVVGWMDAAWSL | (SEQ ID NO: 3202) |
| DDPKLYDKDLGSALGDTVVGWMDAATSL$ | (SEQ ID NO: 3203) |
| DDPKLYDKDLGSALGDTVVGWMDAATSL | (SEQ ID NO: 3204) |
| DDPKLYDKDLGSALGDTVVGQVDAAWSL$ | (SEQ ID NO: 3205) |
| DDPKLYDKDLGSALGDTVVGQVDAAWSL | (SEQ ID NO: 3206) |
| DDPKLYDKDLGSALGDTVVGQVDAATSL$ | (SEQ ID NO: 3207) |
| DDPKLYDKDLGSALGDTVVGQVDAATSL | (SEQ ID NO: 3208) |
| DDPKLYDKDLGSALGDTVVGQLDAAWSL$ | (SEQ ID NO: 3209) |
| DDPKLYDKDLGSALGDTVVGQLDAAWSL | (SEQ ID NO: 3210) |
| DDPKLYDKDLGSALGDTVVGQLDAATSL$ | (SEQ ID NO: 3211) |
| DDPKLYDKDLGSALGDTVVGQLDAATSL | (SEQ ID NO: 3212) |
| DDPKLYDKDLGSALGDTVVGQMDAAWSL$ | (SEQ ID NO: 3213) |
| DDPKLYDKDLGSALGDTVVGQMDAAWSL | (SEQ ID NO: 3214) |
| DDPKLYDKDLGSALGDTVVGQMDAATSL$ | (SEQ ID NO: 3215) |
| DDPKLYDKDLGSALGDTVVGQMDAATSL | (SEQ ID NO: 3216) |
| DDPKLYDKDLGSAMWDWVVAWVDAAWSL$ | (SEQ ID NO: 3217) |
| DDPKLYDKDLGSAMWDWVVAWVDAAWSL | (SEQ ID NO: 3218) |
| DDPKLYDKDLGSAMWDWVVAWVDAATSL$ | (SEQ ID NO: 3219) |
| DDPKLYDKDLGSAMWDWVVAWVDAATSL | (SEQ ID NO: 3220) |
| DDPKLYDKDLGSAMWDWVVAWLDAAWSL$ | (SEQ ID NO: 3221) |
| DDPKLYDKDLGSAMWDWVVAWLDAAWSL | (SEQ ID NO: 3222) |
| DDPKLYDKDLGSAMWDWVVAWLDAATSL$ | (SEQ ID NO: 3223) |
| DDPKLYDKDLGSAMWDWVVAWLDAATSL | (SEQ ID NO: 3224) |
| DDPKLYDKDLGSAMWDWVVAWMDAAWSL$ | (SEQ ID NO: 3225) |
| DDPKLYDKDLGSAMWDWVVAWMDAAWSL | (SEQ ID NO: 3226) |
| DDPKLYDKDLGSAMWDWVVAWMDAATSL$ | (SEQ ID NO: 3227) |
| DDPKLYDKDLGSAMWDWVVAWMDAATSL | (SEQ ID NO: 3228) |

TABLE 3-continued

| Modified Curedoxin-Derived Peptides | |
|---|---|
| DDPKLYDKDLGSAMWDWVVAQVDAAWSL$ | (SEQ ID NO: 3229) |
| DDPKLYDKDLGSAMWDWVVAQVDAAWSL | (SEQ ID NO: 3230) |
| DDPKLYDKDLGSAMWDWVVAQVDAATSL$ | (SEQ ID NO: 3231) |
| DDPKLYDKDLGSAMWDWVVAQVDAATSL | (SEQ ID NO: 3232) |
| DDPKLYDKDLGSAMWDWVVAQLDAAWSL$ | (SEQ ID NO: 3233) |
| DDPKLYDKDLGSAMWDWVVAQLDAAWSL | (SEQ ID NO: 3234) |
| DDPKLYDKDLGSAMWDWVVAQLDAATSL$ | (SEQ ID NO: 3235) |
| DDPKLYDKDLGSAMWDWVVAQLDAATSL | (SEQ ID NO: 3236) |
| DDPKLYDKDLGSAMWDWVVAQMDAAWSL$ | (SEQ ID NO: 3237) |
| DDPKLYDKDLGSAMWDWVVAQMDAAWSL | (SEQ ID NO: 3238) |
| DDPKLYDKDLGSAMWDWVVAQMDAATSL$ | (SEQ ID NO: 3239) |
| DDPKLYDKDLGSAMWDWVVAQMDAATSL | (SEQ ID NO: 3240) |
| DDPKLYDKDLGSAMWDWVVGWVDAAWSL$ | (SEQ ID NO: 3241) |
| DDPKLYDKDLGSAMWDWVVGWVDAAWSL | (SEQ ID NO: 3242) |
| DDPKLYDKDLGSAMWDWVVGWVDAATSL$ | (SEQ ID NO: 3243) |
| DDPKLYDKDLGSAMWDWVVGWVDAATSL | (SEQ ID NO: 3244) |
| DDPKLYDKDLGSAMWDWVVGWLDAAWSL$ | (SEQ ID NO: 3245) |
| DDPKLYDKDLGSAMWDWVVGWLDAAWSL | (SEQ ID NO: 3246) |
| DDPKLYDKDLGSAMWDWVVGWLDAATSL$ | (SEQ ID NO: 3247) |
| DDPKLYDKDLGSAMWDWVVGWLDAATSL | (SEQ ID NO: 3248) |
| DDPKLYDKDLGSAMWDWVVGWMDAAWSL$ | (SEQ ID NO: 3249) |
| DDPKLYDKDLGSAMWDWVVGWMDAAWSL | (SEQ ID NO: 3250) |
| DDPKLYDKDLGSAMWDWVVGWMDAATSL$ | (SEQ ID NO: 3251) |
| DDPKLYDKDLGSAMWDWVVGWMDAATSL | (SEQ ID NO: 3252) |
| DDPKLYDKDLGSAMWDWVVGQVDAAWSL$ | (SEQ ID NO: 3253) |
| DDPKLYDKDLGSAMWDWVVGQVDAAWSL | (SEQ ID NO: 3254) |
| DDPKLYDKDLGSAMWDWVVGQVDAATSL$ | (SEQ ID NO: 3255) |
| DDPKLYDKDLGSAMWDWVVGQVDAATSL | (SEQ ID NO: 3256) |
| DDPKLYDKDLGSAMWDWVVGQLDAAWSL$ | (SEQ ID NO: 3257) |
| DDPKLYDKDLGSAMWDWVVGQLDAAWSL | (SEQ ID NO: 3258) |
| DDPKLYDKDLGSAMWDWVVGQLDAATSL$ | (SEQ ID NO: 3259) |
| DDPKLYDKDLGSAMWDWVVGQLDAATSL | (SEQ ID NO: 3260) |
| DDPKLYDKDLGSAMWDWVVGQMDAAWSL$ | (SEQ ID NO: 3261) |
| DDPKLYDKDLGSAMWDWVVGQMDAAWSL | (SEQ ID NO: 3262) |
| DDPKLYDKDLGSAMWDWVVGQMDAATSL$ | (SEQ ID NO: 3263) |
| DDPKLYDKDLGSAMWDWVVGQMDAATSL | (SEQ ID NO: 3264) |
| DDPKLYDKDLGSAMWDTVVAWVDAAWSL$ | (SEQ ID NO: 3265) |
| DDPKLYDKDLGSAMWDTVVAWVDAAWSL | (SEQ ID NO: 3266) |
| DDPKLYDKDLGSAMWDTVVAWVDAATSL$ | (SEQ ID NO: 3267) |

TABLE 3-continued

| Modified Curedoxin-Derived Peptides | |
|---|---|
| DDPKLYDKDLGSAMWDTVVAWVDAATSL | (SEQ ID NO: 3268) |
| DDPKLYDKDLGSAMWDTVVAWLDAAWSL$ | (SEQ ID NO: 3269) |
| DDPKLYDKDLGSAMWDTVVAWLDAAWSL | (SEQ ID NO: 3270) |
| DDPKLYDKDLGSAMWDTVVAWLDAATSL$ | (SEQ ID NO: 3271) |
| DDPKLYDKDLGSAMWDTVVAWLDAATSL | (SEQ ID NO: 3272) |
| DDPKLYDKDLGSAMWDTVVAWMDAAWSL$ | (SEQ ID NO: 3273) |
| DDPKLYDKDLGSAMWDTVVAWMDAAWSL | (SEQ ID NO: 3274) |
| DDPKLYDKDLGSAMWDTVVAWMDAATSL$ | (SEQ ID NO: 3275) |
| DDPKLYDKDLGSAMWDTVVAWMDAATSL | (SEQ ID NO: 3276) |
| DDPKLYDKDLGSAMWDTVVAQVDAAWSL$ | (SEQ ID NO: 3277) |
| DDPKLYDKDLGSAMWDTVVAQVDAAWSL | (SEQ ID NO: 3278) |
| DDPKLYDKDLGSAMWDTVVAQVDAATSL$ | (SEQ ID NO: 3279) |
| DDPKLYDKDLGSAMWDTVVAQVDAATSL | (SEQ ID NO: 3280) |
| DDPKLYDKDLGSAMWDTVVAQLDAAWSL$ | (SEQ ID NO: 3281) |
| DDPKLYDKDLGSAMWDTVVAQLDAAWSL | (SEQ ID NO: 3282) |
| DDPKLYDKDLGSAMWDTVVAQLDAATSL$ | (SEQ ID NO: 3283) |
| DDPKLYDKDLGSAMWDTVVAQLDAATSL | (SEQ ID NO: 3284) |
| DDPKLYDKDLGSAMWDTVVAQMDAAWSL$ | (SEQ ID NO: 3285) |
| DDPKLYDKDLGSAMWDTVVAQMDAAWSL | (SEQ ID NO: 3286) |
| DDPKLYDKDLGSAMWDTVVAQMDAATSL$ | (SEQ ID NO: 3287) |
| DDPKLYDKDLGSAMWDTVVAQMDAATSL | (SEQ ID NO: 3288) |
| DDPKLYDKDLGSAMWDTVVGWVDAAWSL$ | (SEQ ID NO: 3289) |
| DDPKLYDKDLGSAMWDTVVGWVDAAWSL | (SEQ ID NO: 3290) |
| DDPKLYDKDLGSAMWDTVVGWVDAATSL$ | (SEQ ID NO: 3291) |
| DDPKLYDKDLGSAMWDTVVGWVDAATSL | (SEQ ID NO: 3292) |
| DDPKLYDKDLGSAMWDTVVGWLDAAWSL$ | (SEQ ID NO: 3293) |
| DDPKLYDKDLGSAMWDTVVGWLDAAWSL | (SEQ ID NO: 3294) |
| DDPKLYDKDLGSAMWDTVVGWLDAATSL$ | (SEQ ID NO: 3295) |
| DDPKLYDKDLGSAMWDTVVGWLDAATSL | (SEQ ID NO: 3296) |
| DDPKLYDKDLGSAMWDTVVGWMDAAWSL$ | (SEQ ID NO: 3297) |
| DDPKLYDKDLGSAMWDTVVGWMDAAWSL | (SEQ ID NO: 3298) |
| DDPKLYDKDLGSAMWDTVVGWMDAATSL$ | (SEQ ID NO: 3299) |
| DDPKLYDKDLGSAMWDTVVGWMDAATSL | (SEQ ID NO: 3300) |
| DDPKLYDKDLGSAMWDTVVGQVDAAWSL$ | (SEQ ID NO: 3301) |
| DDPKLYDKDLGSAMWDTVVGQVDAAWSL | (SEQ ID NO: 3302) |
| DDPKLYDKDLGSAMWDTVVGQVDAATSL$ | (SEQ ID NO: 3303) |
| DDPKLYDKDLGSAMWDTVVGQVDAATSL | (SEQ ID NO: 3304) |
| DDPKLYDKDLGSAMWDTVVGQLDAAWSL$ | (SEQ ID NO: 3305) |
| DDPKLYDKDLGSAMWDTVVGQLDAAWSL | (SEQ ID NO: 3306) |

TABLE 3-continued

| Modified Curedoxin-Derived Peptides | |
|---|---|
| DDPKLYDKDLGSAMWDTVVGQLDAATSL$ | (SEQ ID NO: 3307) |
| DDPKLYDKDLGSAMWDTVVGQLDAATSL | (SEQ ID NO: 3308) |
| DDPKLYDKDLGSAMWDTVVGQMDAAWSL$ | (SEQ ID NO: 3309) |
| DDPKLYDKDLGSAMWDTVVGQMDAAWSL | (SEQ ID NO: 3310) |
| DDPKLYDKDLGSAMWDTVVGQMDAATSL$ | (SEQ ID NO: 3311) |
| DDPKLYDKDLGSAMWDTVVGQMDAATSL | (SEQ ID NO: 3312) |
| DDPKLYDKDLGSAMTDWVVAWVDAAWSL$ | (SEQ ID NO: 3313) |
| DDPKLYDKDLGSAMTDWVVAWVDAAWSL | (SEQ ID NO: 3314) |
| DDPKLYDKDLGSAMTDWVVAWVDAATSL$ | (SEQ ID NO: 3315) |
| DDPKLYDKDLGSAMTDWVVAWVDAATSL | (SEQ ID NO: 3316) |
| DDPKLYDKDLGSAMTDWVVAWLDAAWSL$ | (SEQ ID NO: 3317) |
| DDPKLYDKDLGSAMTDWVVAWLDAAWSL | (SEQ ID NO: 3318) |
| DDPKLYDKDLGSAMTDWVVAWLDAATSL$ | (SEQ ID NO: 3319) |
| DDPKLYDKDLGSAMTDWVVAWLDAATSL | (SEQ ID NO: 3320) |
| DDPKLYDKDLGSAMTDWVVAWMDAAWSL$ | (SEQ ID NO: 3321) |
| DDPKLYDKDLGSAMTDWVVAWMDAAWSL | (SEQ ID NO: 3322) |
| DDPKLYDKDLGSAMTDWVVAWMDAATSL$ | (SEQ ID NO: 3323) |
| DDPKLYDKDLGSAMTDWVVAWMDAATSL | (SEQ ID NO: 3324) |
| DDPKLYDKDLGSAMTDWVVAQVDAAWSL$ | (SEQ ID NO: 3325) |
| DDPKLYDKDLGSAMTDWVVAQVDAAWSL | (SEQ ID NO: 3326) |
| DDPKLYDKDLGSAMTDWVVAQVDAATSL$ | (SEQ ID NO: 3327) |
| DDPKLYDKDLGSAMTDWVVAQVDAATSL | (SEQ ID NO: 3328) |
| DDPKLYDKDLGSAMTDWVVAQLDAAWSL$ | (SEQ ID NO: 3329) |
| DDPKLYDKDLGSAMTDWVVAQLDAAWSL | (SEQ ID NO: 3330) |
| DDPKLYDKDLGSAMTDWVVAQLDAATSL$ | (SEQ ID NO: 3331) |
| DDPKLYDKDLGSAMTDWVVAQLDAATSL | (SEQ ID NO: 3332) |
| DDPKLYDKDLGSAMTDWVVAQMDAAWSL$ | (SEQ ID NO: 3333) |
| DDPKLYDKDLGSAMTDWVVAQMDAAWSL | (SEQ ID NO: 3334) |
| DDPKLYDKDLGSAMTDWVVAQMDAATSL$ | (SEQ ID NO: 3335) |
| DDPKLYDKDLGSAMTDWVVAQMDAATSL | (SEQ ID NO: 3336) |
| DDPKLYDKDLGSAMTDWVVGWVDAAWSL$ | (SEQ ID NO: 3337) |
| DDPKLYDKDLGSAMTDWVVGWVDAAWSL | (SEQ ID NO: 3338) |
| DDPKLYDKDLGSAMTDWVVGWVDAATSL$ | (SEQ ID NO: 3339) |
| DDPKLYDKDLGSAMTDWVVGWVDAATSL | (SEQ ID NO: 3340) |
| DDPKLYDKDLGSAMTDWVVGWLDAAWSL$ | (SEQ ID NO: 3341) |
| DDPKLYDKDLGSAMTDWVVGWLDAAWSL | (SEQ ID NO: 3342) |
| DDPKLYDKDLGSAMTDWVVGWLDAATSL$ | (SEQ ID NO: 3343) |
| DDPKLYDKDLGSAMTDWVVGWLDAATSL | (SEQ ID NO: 3344) |
| DDPKLYDKDLGSAMTDWVVGWMDAAWSL$ | (SEQ ID NO: 3345) |

TABLE 3-continued

| Modified Curedoxin-Derived Peptides | |
|---|---|
| DDPKLYDKDLGSAMTDWVVGWMDAAWSL | (SEQ ID NO: 3346) |
| DDPKLYDKDLGSAMTDWVVGWMDAATSL$ | (SEQ ID NO: 3347) |
| DDPKLYDKDLGSAMTDWVVGWMDAATSL | (SEQ ID NO: 3348) |
| DDPKLYDKDLGSAMTDWVVGQVDAAWSL$ | (SEQ ID NO: 3349) |
| DDPKLYDKDLGSAMTDWVVGQVDAAWSL | (SEQ ID NO: 3350) |
| DDPKLYDKDLGSAMTDWVVGQVDAATSL$ | (SEQ ID NO: 3351) |
| DDPKLYDKDLGSAMTDWVVGQVDAATSL | (SEQ ID NO: 3352) |
| DDPKLYDKDLGSAMTDWVVGQLDAAWSL$ | (SEQ ID NO: 3353) |
| DDPKLYDKDLGSAMTDWVVGQLDAAWSL | (SEQ ID NO: 3354) |
| DDPKLYDKDLGSAMTDWVVGQLDAATSL$ | (SEQ ID NO: 3355) |
| DDPKLYDKDLGSAMTDWVVGQLDAATSL | (SEQ ID NO: 3356) |
| DDPKLYDKDLGSAMTDWVVGQMDAAWSL$ | (SEQ ID NO: 3357) |
| DDPKLYDKDLGSAMTDWVVGQMDAAWSL | (SEQ ID NO: 3358) |
| DDPKLYDKDLGSAMTDWVVGQMDAATSL$ | (SEQ ID NO: 3359) |
| DDPKLYDKDLGSAMTDWVVGQMDAATSL | (SEQ ID NO: 3360) |
| DDPKLYDKDLGSAMTDTVVAWVDAAWSL$ | (SEQ ID NO: 3361) |
| DDPKLYDKDLGSAMTDTVVAWVDAAWSL | (SEQ ID NO: 3362) |
| DDPKLYDKDLGSAMTDTVVAWVDAATSL$ | (SEQ ID NO: 3363) |
| DDPKLYDKDLGSAMTDTVVAWVDAATSL | (SEQ ID NO: 3364) |
| DDPKLYDKDLGSAMTDTVVAWLDAAWSL$ | (SEQ ID NO: 3365) |
| DDPKLYDKDLGSAMTDTVVAWLDAAWSL | (SEQ ID NO: 3366) |
| DDPKLYDKDLGSAMTDTVVAWLDAATSL$ | (SEQ ID NO: 3367) |
| DDPKLYDKDLGSAMTDTVVAWLDAATSL | (SEQ ID NO: 3368) |
| DDPKLYDKDLGSAMTDTVVAWMDAAWSL$ | (SEQ ID NO: 3369) |
| DDPKLYDKDLGSAMTDTVVAWMDAAWSL | (SEQ ID NO: 3370) |
| DDPKLYDKDLGSAMTDTVVAWMDAATSL$ | (SEQ ID NO: 3371) |
| DDPKLYDKDLGSAMTDTVVAWMDAATSL | (SEQ ID NO: 3372) |
| DDPKLYDKDLGSAMTDTVVAQVDAAWSL$ | (SEQ ID NO: 3373) |
| DDPKLYDKDLGSAMTDTVVAQVDAAWSL | (SEQ ID NO: 3374) |
| DDPKLYDKDLGSAMTDTVVAQVDAATSL$ | (SEQ ID NO: 3375) |
| DDPKLYDKDLGSAMTDTVVAQVDAATSL | (SEQ ID NO: 3376) |
| DDPKLYDKDLGSAMTDTVVAQLDAAWSL$ | (SEQ ID NO: 3377) |
| DDPKLYDKDLGSAMTDTVVAQLDAAWSL | (SEQ ID NO: 3378) |
| DDPKLYDKDLGSAMTDTVVAQLDAATSL$ | (SEQ ID NO: 3379) |
| DDPKLYDKDLGSAMTDTVVAQLDAATSL | (SEQ ID NO: 3380) |
| DDPKLYDKDLGSAMTDTVVAQMDAAWSL$ | (SEQ ID NO: 3381) |
| DDPKLYDKDLGSAMTDTVVAQMDAAWSL | (SEQ ID NO: 3382) |
| DDPKLYDKDLGSAMTDTVVAQMDAATSL$ | (SEQ ID NO: 3383) |
| DDPKLYDKDLGSAMTDTVVAQMDAATSL | (SEQ ID NO: 3384) |

TABLE 3-continued

| Modified Curedoxin-Derived Peptides | |
|---|---|
| DDPKLYDKDLGSAMTDTVVGWVDAAWSL$ | (SEQ ID NO: 3385) |
| DDPKLYDKDLGSAMTDTVVGWVDAAWSL | (SEQ ID NO: 3386) |
| DDPKLYDKDLGSAMTDTVVGWVDAATSL$ | (SEQ ID NO: 3387) |
| DDPKLYDKDLGSAMTDTVVGWVDAATSL | (SEQ ID NO: 3388) |
| DDPKLYDKDLGSAMTDTVVGWLDAAWSL$ | (SEQ ID NO: 3389) |
| DDPKLYDKDLGSAMTDTVVGWLDAAWSL | (SEQ ID NO: 3390) |
| DDPKLYDKDLGSAMTDTVVGWLDAATSL$ | (SEQ ID NO: 3391) |
| DDPKLYDKDLGSAMTDTVVGWLDAATSL | (SEQ ID NO: 3392) |
| DDPKLYDKDLGSAMTDTVVGWMDAAWSL$ | (SEQ ID NO: 3393) |
| DDPKLYDKDLGSAMTDTVVGWMDAAWSL | (SEQ ID NO: 3394) |
| DDPKLYDKDLGSAMTDTVVGWMDAATSL$ | (SEQ ID NO: 3395) |
| DDPKLYDKDLGSAMTDTVVGWMDAATSL | (SEQ ID NO: 3396) |
| DDPKLYDKDLGSAMTDTVVGQVDAAWSL$ | (SEQ ID NO: 3397) |
| DDPKLYDKDLGSAMTDTVVGQVDAAWSL | (SEQ ID NO: 3398) |
| DDPKLYDKDLGSAMTDTVVGQVDAATSL$ | (SEQ ID NO: 3399) |
| DDPKLYDKDLGSAMTDTVVGQVDAATSL | (SEQ ID NO: 3400) |
| DDPKLYDKDLGSAMTDTVVGQLDAAWSL$ | (SEQ ID NO: 3401) |
| DDPKLYDKDLGSAMTDTVVGQLDAAWSL | (SEQ ID NO: 3402) |
| DDPKLYDKDLGSAMTDTVVGQLDAATSL$ | (SEQ ID NO: 3403) |
| DDPKLYDKDLGSAMTDTVVGQLDAATSL | (SEQ ID NO: 3404) |
| DDPKLYDKDLGSAMTDTVVGQMDAAWSL$ | (SEQ ID NO: 3405) |
| DDPKLYDKDLGSAMTDTVVGQMDAAWSL | (SEQ ID NO: 3406) |
| DDPKLYDKDLGSAMTDTVVGQMDAATSL$ | (SEQ ID NO: 3407) |
| DDPKLYDKDLGSAMTDTVVGQMDAATSL | (SEQ ID NO: 3408) |
| DDPKLYDKDLGSAMGDWVVAWVDAAWSL$ | (SEQ ID NO: 3409) |
| DDPKLYDKDLGSAMGDWVVAWVDAAWSL | (SEQ ID NO: 3410) |
| DDPKLYDKDLGSAMGDWVVAWVDAATSL$ | (SEQ ID NO: 3411) |
| DDPKLYDKDLGSAMGDWVVAWVDAATSL | (SEQ ID NO: 3412) |
| DDPKLYDKDLGSAMGDWVVAWLDAAWSL$ | (SEQ ID NO: 3413) |
| DDPKLYDKDLGSAMGDWVVAWLDAAWSL | (SEQ ID NO: 3414) |
| DDPKLYDKDLGSAMGDWVVAWLDAATSL$ | (SEQ ID NO: 3415) |
| DDPKLYDKDLGSAMGDWVVAWLDAATSL | (SEQ ID NO: 3416) |
| DDPKLYDKDLGSAMGDWVVAWMDAAWSL$ | (SEQ ID NO: 3417) |
| DDPKLYDKDLGSAMGDWVVAWMDAAWSL | (SEQ ID NO: 3418) |
| DDPKLYDKDLGSAMGDWVVAWMDAATSL$ | (SEQ ID NO: 3419) |
| DDPKLYDKDLGSAMGDWVVAWMDAATSL | (SEQ ID NO: 3420) |
| DDPKLYDKDLGSAMGDWVVAQVDAAWSL$ | (SEQ ID NO: 3421) |
| DDPKLYDKDLGSAMGDWVVAQVDAAWSL | (SEQ ID NO: 3422) |
| DDPKLYDKDLGSAMGDWVVAQVDAATSL$ | (SEQ ID NO: 3423) |

TABLE 3-continued

| Modified Curedoxin-Derived Peptides | |
|---|---|
| DDPKLYDKDLGSAMGDWVVAQVDAATSL | (SEQ ID NO: 3424) |
| DDPKLYDKDLGSAMGDWVVAQLDAAWSL$ | (SEQ ID NO: 3425) |
| DDPKLYDKDLGSAMGDWVVAQLDAAWSL | (SEQ ID NO: 3426) |
| DDPKLYDKDLGSAMGDWVVAQLDAATSL$ | (SEQ ID NO: 3427) |
| DDPKLYDKDLGSAMGDWVVAQLDAATSL | (SEQ ID NO: 3428) |
| DDPKLYDKDLGSAMGDWVVAQMDAAWSL$ | (SEQ ID NO: 3429) |
| DDPKLYDKDLGSAMGDWVVAQMDAAWSL | (SEQ ID NO: 3430) |
| DDPKLYDKDLGSAMGDWVVAQMDAATSL$ | (SEQ ID NO: 3431) |
| DDPKLYDKDLGSAMGDWVVAQMDAATSL | (SEQ ID NO: 3432) |
| DDPKLYDKDLGSAMGDWVVGWVDAAWSL$ | (SEQ ID NO: 3433) |
| DDPKLYDKDLGSAMGDWVVGWVDAAWSL | (SEQ ID NO: 3434) |
| DDPKLYDKDLGSAMGDWVVGWVDAATSL$ | (SEQ ID NO: 3435) |
| DDPKLYDKDLGSAMGDWVVGWVDAATSL | (SEQ ID NO: 3436) |
| DDPKLYDKDLGSAMGDWVVGWLDAAWSL$ | (SEQ ID NO: 3437) |
| DDPKLYDKDLGSAMGDWVVGWLDAAWSL | (SEQ ID NO: 3438) |
| DDPKLYDKDLGSAMGDWVVGWLDAATSL$ | (SEQ ID NO: 3439) |
| DDPKLYDKDLGSAMGDWVVGWLDAATSL | (SEQ ID NO: 3440) |
| DDPKLYDKDLGSAMGDWVVGWMDAAWSL$ | (SEQ ID NO: 3441) |
| DDPKLYDKDLGSAMGDWVVGWMDAAWSL | (SEQ ID NO: 3442) |
| DDPKLYDKDLGSAMGDWVVGWMDAATSL$ | (SEQ ID NO: 3443) |
| DDPKLYDKDLGSAMGDWVVGWMDAATSL | (SEQ ID NO: 3444) |
| DDPKLYDKDLGSAMGDWVVGQVDAAWSL$ | (SEQ ID NO: 3445) |
| DDPKLYDKDLGSAMGDWVVGQVDAAWSL | (SEQ ID NO: 3446) |
| DDPKLYDKDLGSAMGDWVVGQVDAATSL$ | (SEQ ID NO: 3447) |
| DDPKLYDKDLGSAMGDWVVGQVDAATSL | (SEQ ID NO: 3448) |
| DDPKLYDKDLGSAMGDWVVGQLDAAWSL$ | (SEQ ID NO: 3449) |
| DDPKLYDKDLGSAMGDWVVGQLDAAWSL | (SEQ ID NO: 3450) |
| DDPKLYDKDLGSAMGDWVVGQLDAATSL$ | (SEQ ID NO: 3451) |
| DDPKLYDKDLGSAMGDWVVGQLDAATSL | (SEQ ID NO: 3452) |
| DDPKLYDKDLGSAMGDWVVGQMDAAWSL$ | (SEQ ID NO: 3453) |
| DDPKLYDKDLGSAMGDWVVGQMDAAWSL | (SEQ ID NO: 3454) |
| DDPKLYDKDLGSAMGDWVVGQMDAATSL$ | (SEQ ID NO: 3455) |
| DDPKLYDKDLGSAMGDWVVGQMDAATSL | (SEQ ID NO: 3456) |
| DDPKLYDKDLGSAMGDTVVAWVDAAWSL$ | (SEQ ID NO: 3457) |
| DDPKLYDKDLGSAMGDTVVAWVDAAWSL | (SEQ ID NO: 3458) |
| DDPKLYDKDLGSAMGDTVVAWVDAATSL$ | (SEQ ID NO: 3459) |
| DDPKLYDKDLGSAMGDTVVAWVDAATSL | (SEQ ID NO: 3460) |
| DDPKLYDKDLGSAMGDTVVAWLDAAWSL$ | (SEQ ID NO: 3461) |
| DDPKLYDKDLGSAMGDTVVAWLDAAWSL | (SEQ ID NO: 3462) |

TABLE 3-continued

| Modified Curedoxin-Derived Peptides | |
|---|---|
| DDPKLYDKDLGSAMGDTVVAWLDAATSL$ | (SEQ ID NO: 3463) |
| DDPKLYDKDLGSAMGDTVVAWLDAATSL | (SEQ ID NO: 3464) |
| DDPKLYDKDLGSAMGDTVVAWMDAAWSL$ | (SEQ ID NO: 3465) |
| DDPKLYDKDLGSAMGDTVVAWMDAAWSL | (SEQ ID NO: 3466) |
| DDPKLYDKDLGSAMGDTVVAWMDAATSL$ | (SEQ ID NO: 3467) |
| DDPKLYDKDLGSAMGDTVVAWMDAATSL | (SEQ ID NO: 3468) |
| DDPKLYDKDLGSAMGDTVVAQVDAAWSL$ | (SEQ ID NO: 3469) |
| DDPKLYDKDLGSAMGDTVVAQVDAAWSL | (SEQ ID NO: 3470) |
| DDPKLYDKDLGSAMGDTVVAQVDAATSL$ | (SEQ ID NO: 3471) |
| DDPKLYDKDLGSAMGDTVVAQVDAATSL | (SEQ ID NO: 3472) |
| DDPKLYDKDLGSAMGDTVVAQLDAAWSL$ | (SEQ ID NO: 3473) |
| DDPKLYDKDLGSAMGDTVVAQLDAAWSL | (SEQ ID NO: 3474) |
| DDPKLYDKDLGSAMGDTVVAQLDAATSL$ | (SEQ ID NO: 3475) |
| DDPKLYDKDLGSAMGDTVVAQLDAATSL | (SEQ ID NO: 3476) |
| DDPKLYDKDLGSAMGDTVVAQMDAAWSL$ | (SEQ ID NO: 3477) |
| DDPKLYDKDLGSAMGDTVVAQMDAAWSL | (SEQ ID NO: 3478) |
| DDPKLYDKDLGSAMGDTVVAQMDAATSL$ | (SEQ ID NO: 3479) |
| DDPKLYDKDLGSAMGDTVVAQMDAATSL | (SEQ ID NO: 3480) |
| DDPKLYDKDLGSAMGDTVVGWVDAAWSL$ | (SEQ ID NO: 3481) |
| DDPKLYDKDLGSAMGDTVVGWVDAAWSL | (SEQ ID NO: 3482) |
| DDPKLYDKDLGSAMGDTVVGWVDAATSL$ | (SEQ ID NO: 3483) |
| DDPKLYDKDLGSAMGDTVVGWVDAATSL | (SEQ ID NO: 3484) |
| DDPKLYDKDLGSAMGDTVVGWLDAAWSL$ | (SEQ ID NO: 3485) |
| DDPKLYDKDLGSAMGDTVVGWLDAAWSL | (SEQ ID NO: 3486) |
| DDPKLYDKDLGSAMGDTVVGWLDAATSL$ | (SEQ ID NO: 3487) |
| DDPKLYDKDLGSAMGDTVVGWLDAATSL | (SEQ ID NO: 3488) |
| DDPKLYDKDLGSAMGDTVVGWMDAAWSL$ | (SEQ ID NO: 3489) |
| DDPKLYDKDLGSAMGDTVVGWMDAAWSL | (SEQ ID NO: 3490) |
| DDPKLYDKDLGSAMGDTVVGWMDAATSL$ | (SEQ ID NO: 3491) |
| DDPKLYDKDLGSAMGDTVVGWMDAATSL | (SEQ ID NO: 3492) |
| DDPKLYDKDLGSAMGDTVVGQVDAAWSL$ | (SEQ ID NO: 3493) |
| DDPKLYDKDLGSAMGDTVVGQVDAAWSL | (SEQ ID NO: 3494) |
| DDPKLYDKDLGSAMGDTVVGQVDAATSL$ | (SEQ ID NO: 3495) |
| DDPKLYDKDLGSAMGDTVVGQVDAATSL | (SEQ ID NO: 3496) |
| DDPKLYDKDLGSAMGDTVVGQLDAAWSL$ | (SEQ ID NO: 3497) |
| DDPKLYDKDLGSAMGDTVVGQLDAAWSL | (SEQ ID NO: 3498) |
| DDPKLYDKDLGSAMGDTVVGQLDAATSL$ | (SEQ ID NO: 3499) |
| DDPKLYDKDLGSAMGDTVVGQLDAATSL | (SEQ ID NO: 3500) |
| DDPKLYDKDLGSAMGDTVVGQMDAAWSL$ | (SEQ ID NO: 3501) |
| DDPKLYDKDLGSAMGDTVVGQMDAAWSL | (SEQ ID NO: 3502) |
| DDPKLYDKDLGSAMGDTVVGQMDAATSL$ | (SEQ ID NO: 3503) |
| DDPKLYDKDLGSAMGDTVVGQMDAATSL | (SEQ ID NO: 3504) |

*is acetylated.
$is amidated

PEGylation

Covalent attachment of PEG to drugs of therapeutic and diagnostic importance has extended the plasma half-life of the drug in vivo, and/or reduced their immunogenicity and antigenicity. Harris and Chess, Nature Reviews Drug Discovery 2:214-221 (2003). For example, PEG attachment has improved the pharmacokinetic properties of many therapeutic proteins, including interleukins (Kaufman et al., J. Biol. Chem. 263:15064 (1988); Tsutsumi et al., J. Controlled Release 33:447 (1995)), interferons (Kita et al., Drug Des. Delivery 6:157 (1990)), catalase (Abuchowski et al., J. Biol. Chem. 252:3582 (1977)), superoxide dismutase (Beauchamp et al., Anal. Biochem. 131:25 (1983)), and adenosine deanimase (Chen et al., Biochem. Biophys. Acta 660:293 (1981)), among others. The FDA has approved PEG for use as a vehicle or base in foods, cosmetics and pharmaceuticals, including injectable, topical, rectal and nasal formulations. PEG shows little toxicity, and is eliminated from the body intact by either the kidneys (for PEGs <30 kDa) or in the feces (for PEGs >20 kDa). PEG is highly soluble in water.

PEGylation of a therapeutic peptide may be used to increase the lifetime of the peptide in the bloodstream of the patient by reducing renal ultrafiltration, and thus reduce elimination of the drug from the body. Charge masking may affect renal permeation. Charge masking may be a consequence of the paramchemical modification of protein ionizable functional group, namely amines or carboxyls. In particular, the most common procedures for producing protein—PEG derivatives involves the conversion of protein amino groups into amides with the consequent loss of positive charges, and this can alter protein ultrafiltration. Since anionic macromolecules have been found to be cleared by renal ultrafiltration more slowly than neutral or positive ones, it could be expected that PEG conjugation to amino groups prolongs the permanence of the PEGylated peptide in the bloodstream.

Molecular size and globular ultrafiltration may also affect renal ultrafiltration of therapeutic peptides. The molecular weight cut off for kidney elimination of native globular proteins is considered to be about 70 kDa, which is close to the molecular weight of serum albumin. Thus, proteins with molecular weight exceeding 70 kDa are mainly eliminated from the body by pathways other than renal ultrafiltration, such as liver uptake, proteolytic digestion and clearance by the immune system. Therefore, increasing the size of a therapeutic peptide by PEGylation may decrease renal ultrafiltration of that peptide form the bloodstream of the patient.

Additionally, PEGylation of a therapeutic peptide may decrease the immunogenicity of that peptide, as well as protect the peptide from proteolytic enzymes, phagocytic cells, and other factors that require direct contact with the therapeutic peptide. The umbrella-like structure of branched PEG in particular has been found to give better protection than linear PEG towards approaching proteolytic enzymes, antibodies, phagocytic cells, etc. Caliceti and Veronese, Adv. Drug. Deliv. Rev. 55:1261-12778 (2003).

In some embodiments, the cupredoxin derived peptides are modified to have one or more PEG molecules covalently bonded to a cysteine molecule. The covalent bonding does not necessarily need to be a covalent bond directly from the PEG molecule to the cupredoxin derived peptide, but may be covalently bonded to one or more linker molecules which in turn are covalently bonded to each other and/or the cupredoxin derived peptide. In some embodiments, the cupredoxin derived peptide have site-specific PEGylation. In specific embodiments, the PEG molecule(s) may be covalently bonded to the cysteine residues 3, 26 and/or 112 of *P. aeruginosa* azurin (SEQ ID NO: 1). In other embodiments, one or more cysteine residues may be substituted into the cupredoxin derived peptide and is PEGylated. In some embodiments, the method to PEGylate the cupredoxin derived peptide may be NHS, reductive animation, malimid or epoxid, among others. In other embodiments, the cupredoxin derived peptides may be PEGylated on one or more lysine, cysteine, histidine, arginine, aspartic acid, glutamic acid, serine, threonine, or tyrosine, or the N-terminal amino group or the C-terminal carboxylic acid. In more specific embodiments, the cupredoxin derived peptides may be PEGylated on one or more lysines or N-terminal amino groups. In other embodiments, one or more lysine, cysteine, histidine, arginine, aspartic acid, glutamic acid, serine, threonine, or tyrosine residue are substituted into the cupredoxin derived peptides and are PEGylated. In other embodiments, the cupredoxin derived peptides may be PEGylated on one or more amino groups. In other embodiments, the cupredoxin derived peptides may be PEGylated in a random, non-site specific manner. In some embodiments, the cupredoxin derived peptides may have an average molecular weight of PEG-based polymers of about 200 daltons to about 100,000 daltons, about 2,000 daltons to about 20,000 daltons, or about 2,000 daltons to about 5,000 daltons. In other embodiments, the cupredoxin derived peptides may be comprised of one or more PEG molecules that is branched, specifically a branched PEG molecule that is about 50 kDa. In other embodiments, the cupredoxin derived peptides may comprise one or more linear PEG molecules, specifically a linear PEG molecule that is about 5 kDa.

Cupredoxins

"Cupredoxins" are small blue copper containing proteins having electron transfer properties (10-20 kDa) that participate in, for example, bacterial redox chains or photosynthesis. The copper ion is solely bound by the protein matrix. A special distorted trigonal planar arrangement to two histidine and one cysteinate ligands around the copper gives rise to very peculiar electronic properties of the metal site and an intense blue color. A number of cupredoxins have been crystallographically characterized at medium to high resolution. The cupredoxins include the azurins, plastocyanins, rusticyanins, pseudoazurins, auracyanins and azurin-like proteins. As used herein, the term "cupredoxin" includes the protein form without the copper atom present, as well as the copper containing protein.

Azurins

The azurins are copper containing proteins of 128 amino acid residues which belong to the family of cupredoxins involved in electron transfer in plants and certain bacteria. The azurins include those from *P. aeruginosa* (SEQ ID NO: 1)("wt-azurin"), *A. xylosoxidans*, and *A. denitrificans*. Murphy et al., J. Mol. Biol. 315:859-871 (2002). Although the sequence homology between the azurins varies between 60-90%, the structural homology between these molecules is high. All azurins have a characteristic β-sandwich with Greek key motif and the single copper atom is always placed at the same region of the protein. In addition, azurins possess an essentially neutral hydrophobic patch surrounding the copper site. Id.

Plastocyanins

The plastocyanins are cupredoxins that are found in eukaryotic plants and cyanobacteria. They contain one molecule of copper per molecule and are blue in their oxidized form. They occur in the chloroplast, where they function as electron carriers. Since the determination of the structure of poplar plastocyanin in 1978, the structure of algal (*Scenedesmus, Enteromorpha, Chlamydomonas*) and plant (French bean) plastocyanins has been determined either by crystallographic or NMR methods, and the poplar structure has been refined to 1.33 Å resolution. SEQ ID NO: 2 shows the amino acid sequence of plastocyanin from the cyanobacterium *Phormidium laminosum.*

Despite the sequence divergence among plastocyanins of algae and vascular plants (e.g., 62% sequence identity between the *Chlamydomonas* and poplar proteins), the three-dimensional structures are conserved (e.g., 0.76 Å rms deviation in the C alpha positions between the *Chlamydomonas* and Poplar proteins). Structural features include a distorted tetrahedral copper binding site at one end of an eight-stranded antiparallel beta-barrel, a pronounced negative patch, and a flat hydrophobic surface. The copper site is optimized for its electron transfer function, and the negative and hydrophobic patches are proposed to be involved in recognition of physiological reaction partners. Chemical modification, cross-linking, and site-directed mutagenesis experiments have confirmed the importance of the negative and hydrophobic patches in binding interactions with cytochrome f, and validated the model of two functionally significant electron transfer paths in plastocyanin. One putative electron transfer path is relatively short (approximately 4 Å) and involves the solvent-exposed copper ligand His-87 in the hydrophobic patch, while the other is more lengthy (approximately 12-15 Å) and involves the nearly conserved residue Tyr-83 in the negative patch. Redinbo et al., J. Bioenerg. Biomembr. 26(1):49-66 (1994).

Rusticyanins

Rusticyanins are blue-copper containing single-chain polypeptides obtained from a thiobacillus. The X-ray crystal structure of the oxidized form of the extremely stable and highly oxidizing cupredoxin rusticyanin from *Thiobacillus ferrooxidans* (SEQ ID NO: 3) has been determined by multiwavelength anomalous diffraction and refined to 1.9 Å resolution. The rusticyanins are composed of a core beta-sandwich fold composed of a six- and a seven-stranded β-sheet. Like other cupredoxins, the copper ion is coordinated by a cluster of four conserved residues (His 85, Cys138, His143, Met148) arranged in a distorted tetrahedron. Walter et al., J. Mol. Biol. 263:730-51 (1996).

Auracyanins

Three small blue copper proteins designated auracyanin A, auracyanin B 1, and auracyanin B-2 have been isolated from the thermophilic green gliding photosynthetic bacterium Chloroflexus aurantiacus. The two B forms have almost identical properties to each other, but are distinct from the A form. The sodium dodecyl sulfate-polyacrylamide gel electrophoresis demonstrates apparent monomer molecular masses as 14 (A), 18 (B-2), and 22 (B-1) kDa.

The amino acid sequence of auracyanin A has been determined and showed auracyanin A to be a polypeptide of 139 residues. Van Dreissche et al, Protein Science 8:947-957 (1999). His58, Cys123, His128, and Met132 are spaced in a way to be expected if they are the evolutionary conserved metal ligands as in the known small copper proteins plastocyanin and azurin. Secondary structure prediction also indicates that auracyanin has a general beta-barrel structure similar to that of azurin from *Pseudomonas aeruginosa* and plastocyanin from poplar leaves. However, auracyanin appears to have sequence characteristics of both small copper protein sequence classes. The overall similarity with a consensus sequence of azurin is roughly the same as that with a consensus sequence of plastocyanin, namely 30.5%. The N-terminal sequence region 1-18 of auracyanin is remarkably rich in glycine and hydroxy amino acids. Id. See exemplary amino acid sequence SEQ ID NO: 10 for chain A of auracyanin from *Chloroflexus aurantiacus* (NCBI Protein Data Bank Accession No. AAM12874).

The auracyanin B molecule has a standard cupredoxin fold. The crystal structure of auracyanin B from Chloroflexus aurantiacus has been studied. Bond et al., J. Mol. Biol. 306:47-67 (2001). With the exception of an additional N-terminal strand, the molecule is very similar to that of the bacterial cupredoxin, azurin. As in other cupredoxins, one of the Cu ligands lies on strand 4 of the polypeptide, and the other three lie along a large loop between strands 7 and 8. The Cu site geometry is discussed with reference to the amino acid spacing between the latter three ligands. The crystallographically characterized Cu-binding domain of auracyanin B is probably tethered to the periplasmic side of the cytoplasmic membrane by an N-terminal tail that exhibits significant sequence identity with known tethers in several other membrane-associated electron-transfer proteins. The amino acid sequences of the B forms are presented in McManus et al. (J Biol. Chem. 267:6531-6540 (1992)). See exemplary amino acid sequence SEQ ID NO: 11 for chain A of auracyanin B from Chloroflexus aurantiacus (NCBI Protein Data Bank Accession No. 1 QHQA).

Pseudoazurins

The pseudoazurins are a family of blue-copper containing single-chain polypeptides. The amino acid sequence of pseudoazurin obtained from *Achromobacter cycloclastes* is shown in SEQ ID NO: 4. The X-ray structure analysis of pseudoazurin shows that it has a similar structure to the azurins although there is low sequence homology between these proteins. Two main differences exist between the overall structure of the pseudoazurins and azurins. There is a carboxy terminus extension in the pseudoazurins, relative to the azurins, consisting of two alpha-helices. In the mid-peptide region azurins contain an extended loop, shortened in the pseudoazurins, which forms a flap containing a short α-helix. The only major differences at the copper atom site are the conformation of the MET side-chain and the Met-S copper bond length, which is significantly shorter in pseudoazurin than in azurin.

The modified cupredoxin derived peptides may be synthesized by standard techniques. Variants are amino acid sequences formed from native compounds either directly or by modification or partial substitution. Changes may be introduced into a cupredoxin derived peptide that incur alterations in the amino acid sequences of the cupredoxin derived peptide that do nullify the pharmacologic activity (ies) of the cupredoxin. A "non-essential" amino acid residue is a residue that can be altered from the sequence of the cupredoxin derived peptide without nullifying its pharmacologic activity, whereas an "essential" amino acid residue is required for such pharmacologic activity.

Amino acids for which "conservative" substitutions can be made are well known in the art. Useful conservative substitutions are shown in Table 1, "Preferred substitutions." Conservative substitutions whereby an amino acid of one class is replaced with another amino acid of the same class fall within the scope of the invention so long as the substitution does not nullify the desired pharmacologic activity of the cupredoxin derived peptide. Such exchanges that result in altered cupredoxin derived pharmacologic activity are contemplated as part of the invention so long as such pharmacologic activity is appreciable. In some embodiments, the pharmacologic activity of the cupredoxin derived peptide is less that about 5%, less than about 10%, less than about 25% and less than about 50% of the specific activity of the wild type cupredoxin from which it is derived. It will be appreciated that some loss of specific activity of the cupredoxin derived peptide may be tolerated if it is offset by other improved qualities in the cupredoxin derived peptide, such as longer plasma half-life or decreased immunogenicity.

TABLE 1

| Preferred substitutions | | |
|---|---|---|
| Original residue | Exemplary substitutions | Preferred substitutions |
| Ala (A) | Val, Leu, Ile | Val |
| Arg (R) | Lys, Gln, Asn | Lys |
| Asn (N) | Gln, His, Lys, Arg | Gln |
| Asp (D) | Glu | Glu |
| Cys (C) | Ser | Ser |
| Gln (Q) | Asn | Asn |
| Glu (E) | Asp | Asp |
| Gly (G) | Pro, Ala | Ala |
| His (H) | Asn, Gln, Lys, Arg | Arg |
| Ile (I) | Leu, Val, Met, Ala, Phe, Norleucine | Leu |
| Leu (L) | Norleucine, Ile, Val, Met, Ala, Phe | Ile |
| Lys (K) | Arg, Gln, Asn | Arg |
| Met (M) | Leu, Phe, Ile | Leu |
| Phe (F) | Leu, Val, Ile, Ala, Tyr | Leu |
| Pro (P) | Ala | Ala |
| Ser (S) | Thr | Thr |
| Thr (T) | Ser | Ser |
| Trp (W) | Tyr, Phe | Tyr |
| Tyr (Y) | Trp, Phe, Thr, Ser | Phe |
| Val (V) | Ile, Leu, Met, Phe, Ala, Norleucine | Leu |

"Non-conservative" substitutions that affect (1) the structure of the polypeptide backbone, such as a β-sheet or α-helical conformation, (2) the charge, (3) hydrophobicity, or (4) the bulk of the side chain can modify pharmacologic activity of a cupredoxin derived peptide. Residues are divided into groups based on common side-chain properties as denoted in Table 2. Non-conservative substitutions entail exchanging a member of one of these classes for another class.

Non-conservative substitutions whereby an amino acid of one class is replaced with another amino acid of a different class fall within the scope of the invention so long as the substitution does not nullify the pharmacologic activity of the cupredoxin derived peptide. Such exchanges that result in altered cupredoxin derived peptide pharmacologic activity are contemplated as part of the invention so long as such pharmacologic activity is appreciable.

TABLE 2

| Amino acid classes | |
|---|---|
| Class | Amino acids |
| hydrophobic | Norleucine, Met, Ala, Val, Leu, Ile |
| neutral hydrophilic | Cys, Ser, Thr |
| acidic | Asp, Glu |
| basic | Asn, Gln, His, Lys, Arg |

TABLE 2-continued

| Amino acid classes | |
|---|---|
| Class | Amino acids |
| disrupt chain conformation | Gly, Pro |
| aromatic | Trp, Tyr, Phe |

Modifications to the cupredoxin derived peptide can be made using methods known in the art such as oligonucleotide-mediated (site-directed) mutagenesis, alanine scanning, and PCR mutagenesis. Site-directed mutagenesis (Carter, Biochem J. 237:1-7 (1986); Zoller and Smith, Methods Enzymol. 154:329-50 (1987)), cassette mutagenesis, restriction selection mutagenesis (Wells et al., Gene 34:315-23 (1985)) or other known techniques can be performed on the cloned DNA to produce a cupredoxin derived peptide encoding variant nucleic acid. In addition, nucleotides encoding a cupredoxin derived peptide that is a structural equivalent of a cupredoxin may be synthesized by methods that are well known in the art. Further, protein molecules that are modified cupredoxin derived peptide may be synthesized by methods that are well known in the art.

Nucleic Acids Coding for a Cupredoxin Entry Domain and Complex of a Cupredoxin Entry Domain Linked to a Cargo Compound In another aspect, the present invention provides a nucleic acid molecule encoding a modified cupredoxin derived peptide of the invention. This nucleic acid molecule can be prepared by a combination of known techniques in the art. For instance, nucleic acid sequences for the modified cupredoxin derived peptide can individually be prepared by chemical synthesis or cloning.

Hybrid Systems Comprising a Cupredoxin, Modified Cupredoxin, or Modified Cupredoxin-Derived Peptide and a Nanoparticle In another aspect, the present invention provides a biological molecule that is a cupredoxin, such as *P. aeruginosa* azurin (SEQ ID NO: 1), and/or a cupredoxin-derived peptide, which may be modified using one or more of the methods or techniques disclosed herein, conjugated with a nanoparticle, which may be a noble metal such as gold or platinum. The biological molecule may be conjugated to the nanoparticle via electronic interactions or other means. Specifically, conjugation may be via electron transfer. See Delfino, I. and Cannistraro, S., “Optical investigation of the electron transfer protein azurin-gold nanoparticle system,” Biophysical Chemistry 139 (2009) 1-7 (available online 30 Sep. 2008), the disclosure of which is incorporated by reference in its entirety herein.

In some embodiments, hybrid systems comprising a modified cupredoxin-derived peptide and a nanoparticle may be used for purposes of imaging, diagnostics, and/or cancer therapy.

Pharmaceutical Compositions Containing Modified Cupredoxin Derived Peptides

Pharmaceutical compositions containing a modified cupredoxin derived peptide can be manufactured in any conventional manner, e.g., by conventional mixing, dissolving, granulating, dragee-making, emulsifying, encapsulating, entrapping, or lyophilizing processes. The modified cupredoxin derived peptide can be readily combined with a pharmaceutically acceptable carrier well-known in the art. Such carriers enable the preparation to be formulated as a tablet, pill, dragee, capsule, liquid, gel, syrup, slurry, suspension, and the like. Suitable excipients can also include, for example, fillers and cellulose preparations. Other excipients can include, for example, flavoring agents, coloring agents, detackifiers, thickeners, and other acceptable additives, adjuvants, or binders.

Such compositions can be used in, for example, the treatment or diagnosis of cancer, treatment of inappropriate angiogenesis, infection by HIV and/or malaria, and treatment of conditions related to ephrin-signaling. The compositions can be administered in an amount sufficient to prevent or treat the condition from which the patient is suffering. Typically, the patient organism is a mammal, such as a human or animal.

Administration of Compositions Containing a Cupredoxin Entry Domain

Compositions containing a modified cupredoxin derived peptide can be administered by any suitable route, for example, by oral, buccal, inhalation, sublingual, rectal, vaginal, transurethral, nasal, topical, percutaneous, i.e., transdermal or parenteral (including intravenous, intramuscular, subcutaneous and intracoronary administration). The compositions and pharmaceutical formulations thereof can be administered in any amount effective to achieve its intended purpose. When administrated to treat a patient suffering from a condition, the composition is administered in a therapeutically effective amount. A “therapeutically effective amount” is an amount effective to prevent development of, or to alleviate the existing symptoms of, the subject being treated. Determination of a therapeutically effective amount is well within the capability of those skilled in the art.

In various embodiments, the composition includes carriers and excipients (including but not limited to buffers, carbohydrates, mannitol, proteins, polypeptides or amino acids such as glycine, antioxidants, bacteriostats, chelating agents, suspending agents, thickening agents and/or preservatives), water, oils, saline solutions, aqueous dextrose and glycerol solutions, other pharmaceutically acceptable auxiliary substances as required to approximate pharmacologic conditions, such as buffering agents, tonicity adjusting agents, wetting agents and the like. It will be recognized that, while any suitable carrier known to those of ordinary skill in the art may be employed to administer the compositions of this invention, the type of carrier will vary depending on the mode of administration. Compounds may also be encapsulated within liposomes using well-known technology. Biodegradable microspheres may also be employed as carriers for the compositions of this invention. Suitable biodegradable microspheres are shown, for example, in U.S. Pat. Nos. 4,897,268, 5,075,109, 5,928,647, 5,811,128, 5,820,883, 5,853,763, 5,814,344 and 5,942,252. “Compounds” as used herein, include the peptides, amino acid sequences, cargo compounds and complexes of the present invention.

The compositions of the invention may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions of the invention may be administered in a variety of ways, including by injection (e.g., intradermal, subcutaneous, intramuscular, intraperitoneal and the like), by inhalation, by topical administration, by suppository, by using a transdermal patch or by mouth.

When administration is by injection, composition may be formulated in aqueous solutions, preferably in physiologically compatible buffers such as Hanks solution, Ringer's solution, or physiological saline buffer. The solution may contain formulatory agents such as suspending, stabilizing and/or dispersing agents. Alternatively, the composition may be in powder form for constitution with a suitable vehicle, e.g., sterile pyrogen-free water, before use.

When administration is by inhalation, the composition may be delivered in the form of an aerosol spray from pressurized packs or a nebulizer with the use of a suitable propellant, e.g., dichlorodifluoromethane, trichlorofluoromethane, carbon dioxide or other suitable gas. In the case of a pressurized aerosol, the dosage unit may be determined by providing a valve to deliver a metered amount. Capsules and cartridges of, e.g., gelatin for use in an inhaler or insufflator may be formulated containing a powder mix of the proteins and a suitable powder base such as lactose or starch.

When administration is by topical administration, the composition may be formulated as solutions, gels, ointments, creams, suspensions, and the like, as are well known in the art. In some embodiments, administration is by means of a transdermal patch. When administration is by suppository (e.g., rectal or vaginal), composition may also be formulated in compositions containing conventional suppository bases.

When administration is oral, the composition can be readily formulated in combination with pharmaceutically acceptable carriers well known in the art. A solid carrier, such as mannitol, lactose, magnesium stearate, and the like may be employed; such carriers enable the chemotaxin to be formulated as tablets, pills, dragees, capsules, liquids, gels, syrups, slurries, suspensions and the like, for oral ingestion by a subject to be treated. For oral solid formulations such as, for example, powders, capsules and tablets, suitable excipients include fillers such as sugars, cellulose preparation, granulating agents, and binding agents.

Other convenient carriers, as well-known in the art, also include multivalent carriers, such as bacterial capsular polysaccharide, a dextran or a genetically engineered vector. In addition, sustained-release formulations that include the composition allow for the release of the composition over extended periods of time, such that without the sustained release formulation, composition would be cleared from a subject's system, and/or degraded by, for example, proteases and simple hydrolysis before eliciting or enhancing an therapeutic effect.

The exact formulation, route of administration, and dosage is typically determined by the attending physician in view of the patient's condition. Dosage amount and interval can be adjusted individually to provide plasma levels of the complex which are sufficient to maintain therapeutic effect. Generally, the desired composition is administered in an admixture with a pharmaceutical carrier selected with regard to the intended route of administration and standard pharmaceutical practice.

The appropriate dosage will, of course, vary depending upon, for example, the compound containing the cupredoxin entry domain employed, the host, the mode of administration and the nature and severity of the conditions being treated or diagnosed. However, in one embodiment of the methods of the present invention, satisfactory treatment results in humans are indicated to be obtained at daily dosages from about 0.001 to about 20 mg/kg of body weight of the compound containing the modified cupredoxin derived peptide. In one embodiment, an indicated daily dosage for treatment in humans may be in the range from about 0.7 mg to about 1400 mg of a compound containing the modified cupredoxin derived peptide conveniently administered, for example, in daily doses, weekly doses, monthly doses, and/or continuous dosing. Daily doses can be in discrete dosages from 1 to 12 times per day. Alternatively, doses can be administered every other day, every third day, every fourth day, every fifth day, every sixth day, every week, and similarly in day increments up to 31 days. Dosing can be continuous, intermittent or a single dose, using any applicable dosing form, including tablet, patches, i.v. administration and the like. More specifically, the composition is administered in a therapeutically effective amount. In specific embodiments, the therapeutically effective amount is from about 0.01-20 mg/kg of body weight. In specific embodiments, the dose level is about 10 mg/kg/day, about 15 mg/kg/day, about 20 mg/kg/day, about 25 mg/kg/day, about 30 mg/kg/day, about 35 mg/kg/day, about 40 mg/kg/day, about 45 mg/kg/day or about 50 mg/kg/day.

The method of introducing compounds containing the modified cupredoxin derived peptide to patients is, in some embodiments, co-administration with other drugs known to treat the condition. Such methods are well-known in the art. In a specific embodiment, the compounds containing the modified cupredoxin derived peptide are part of an cocktail or co-dosing containing or with other drugs for treating cancer, HIV, malaria, inappropriate angiogenesis, and conditions related to ephrin-signaling. Many other such compounds are known to those skilled in the art and are provided by the patent applications that have been expressly incorporated by reference.

Nucleic acid molecules encoding a cupredoxin derived peptide or a fusion protein combining a cupredoxin derived peptide and a cargo compound can be inserted into vectors and used as gene therapy vectors. Gene therapy vectors can be delivered to a subject by, for example, intravenous injection, local administration (Nabel et al., U.S. Pat. No. 5,328,470), or by stereotactic injection (Chen et al., Proc Natl Acad Sci USA 91:3054-3057 (1994)). The pharmaceutical preparation of a gene therapy vector can include an acceptable diluent or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

In one aspect, the composition is delivered as DNA such that the complex is generated in situ. In one embodiment, the DNA is "naked," as described, for example, in Ulmer et al., Science 259:1745-1749 (1993) and reviewed by Cohen, Science 259 1691-1692 (1993). The uptake of naked DNA may be increased by coating the DNA onto a carrier, e.g. a biodegradable bead, which is efficiently transported into the cells. In such methods, the DNA may be present within any of a variety of delivery systems known to those of ordinary skill in the art, including nucleic acid expression systems, bacterial and viral expression systems. Techniques for incorporating DNA into such expression systems are well known to those of ordinary skill in the art. See, e.g., WO90/11092, WO93/24640, WO 93/17706, and U.S. Pat. No. 5,736,524.

Vectors, used to shuttle genetic material from organism to organism, can be divided into two general classes: Cloning vectors are replicating plasmid or phage with regions that are non-essential for propagation in an appropriate host cell and into which foreign DNA can be inserted; the foreign DNA is replicated and propagated as if it were a component of the vector. An expression vector (such as a plasmid, yeast, or animal virus genome) is used to introduce foreign genetic material into a host cell or tissue in order to transcribe and translate the foreign DNA, such as the DNA of the composition. In expression vectors, the introduced DNA is operably-linked to elements such as promoters that signal to the host cell to transcribe the inserted DNA. Some promoters are exceptionally useful, such as inducible promoters that control gene transcription in response to specific factors. Operably-linking a composition polynucleotide to an inducible promoter can control the expression of a modified cupredoxin derived peptide of the invention. Examples of classic inducible promoters include those that are responsive to α-interferon, heat shock, heavy metal ions, and steroids such as glucocorticoids (Kaufman, Methods Enzymol. 185:487-511 (1990)) and tetracycline. Other desirable inducible promoters include those that are not endogenous to the cells in which the construct is being introduced, but, however, are responsive in those cells when the induction agent is exogenously supplied. In general, useful expression vectors are often plasmids. However, other forms of expression vectors, such as viral vectors (e.g., replication defective retroviruses, adenoviruses and adeno-associated viruses) are contemplated.

Vector choice is dictated by the organism or cells being used and the desired fate of the vector. In general, vectors comprise signal sequences, origins of replication, marker genes, enhancer elements, promoters, and transcription termination sequences.

Kits Comprising a Modified Cupredoxin Derived Peptide

In another aspect, the invention provides kits containing one or more of the following in a package or container: (1) a reagent comprising a modified cupredoxin derived peptide; (2) a reagent containing a pharmaceutically acceptable adjuvant or excipient; (3) a vehicle for administration, such as a syringe; and (4) instructions for administration. Embodiments in which two or more of components (1)-(4) are found in the same container are also contemplated.

When a kit is supplied, the different components of the composition may be packaged in separate containers and admixed immediately before use. Such packaging of the components separately may permit long-term storage without losing the active components' functions.

The reagents included in the kit can be supplied in containers of any sort such that the life of the different components are preserved and are not adsorbed or altered by the materials of the container. For example, sealed glass ampules may contain lyophilized polypeptide or polynucleotide, or buffers that have been packaged under a neutral, non-reacting gas, such as nitrogen. Ampules may consist of any suitable material, such as glass, organic polymers, such as polycarbonate, polystyrene, etc., ceramic, metal or any other material typically employed to hold similar reagents. Other examples of suitable containers include simple bottles that may be fabricated from similar substances as ampules, and envelopes, that may comprise foil-lined interiors, such as aluminum or an alloy. Other containers include test tubes, vials, flasks, bottles, syringes, or the like. Containers may have a sterile access port, such as a bottle having a stopper that can be pierced by a hypodermic injection needle. Other containers may have two compartments that are separated by a readily removable membrane that upon removal permits the components to be mixed. Removable membranes may be glass, plastic, rubber, etc.

Kits may also be supplied with instructional materials. Instructions may be printed on paper or other substrate, and/or may be supplied as an electronic-readable medium, such as a floppy disc, CD-ROM, DVD-ROM, Zip disc, videotape, audiotape, flash memory device, etc. Detailed instructions may not be physically associated with the kit; instead, a user may be directed to an internet web site specified by the manufacturer or distributor of the kit, or supplied as electronic mail.

A more complete understanding of the present invention can be obtained by reference to the following specific Examples. The Examples are described solely for purposes of illustration and are not intended to limit the scope of the invention. Changes in form and substitution of equivalents are contemplated as circumstances may suggest or render expedient. Although specific terms have been employed herein, such terms are intended in a descriptive sense and not for purposes of limitations. Modifications and variations of the invention as hereinbefore set forth can be made without departing from the spirit and scope thereof, and, therefore, only such limitations should be imposed as are indicated by the appended embodiments.

EXAMPLES

Example 1

Treatment of Patients Suffering from Cancer with Modified Cupredoxin Derived Peptides A Phase I/II clinical trial of a thioether cyclized p28 (SEQ ID NO: 13) fusion (Study Drug) will be performed in patients suffering from cancer. Specifically, p28 (SEQ ID NO: 13) from *Pseudomonas aeruginosa* will be modified by thioether cyclization.

Forty-nine adult patients with histologically verified cancers of the breast, colon and melanoma who demonstrate clinical and radiographic progression or recurrence following adequate treatment by currently available FDA-approved chemotherapeutic drugs and regimen will be enrolled in an open-label prospective study administering the Study Drug. To be eligible for enrollment in the study, all patients demonstrate increasing volume of measurable tumor after completion of approved course of chemotherapy regimens. The evidence of persistent metastatic deposits and/or continued increase in size or volume must be histologically established. This histological proof can be obtained by a fine needle aspiration (FNA) biopsy.

The treatment program will be instituted after obtaining informed consent from all patients in accordance with the Institutional Review Board of the University of Illinois, Chicago and the FDA. The patients will have no intercurrent illness such as other malignancy, history of previous malignancy, blood dyscrasias, insulin dependent diabetes or other serious cardiovascular diseases which might interfere in appropriate evaluation of the effects of the proposed therapy. Baseline blood work (Complete Blood Counts [CBC] and Serum Chemistry) including liver function studies (LFT) will be performed prior to initiation of therapy. All eligible patients must not receive any cancer chemotherapy concurrently during the period of the trial.

The study drug will be administered by daily intravenous injection of a pharmaceutically acceptable preparation of the Study Drug for 12 weeks and the subjects will be observed for any dose limiting toxicity. There will be 7 dose levels starting with 10 mg/kg/day and increasing by 5 mg/kg/day up to a maximum dose of 50 mg/kg/day. The efficacy of each dose level will be recorded in 7 patients with advanced measurable cancer (breast, colon, and melanoma).

The response will be estimated by measuring the measurable tumor in 2 dimensions (a and b). 1) Total disappearance of the target metastatic tumors will be considered as complete response (CR); 2) A 75% reduction will be considered excellent, partial response (PR); and 3) A good response (PR) will be post treatment reduction in size by 50%. 4) Reduction of 25% in size will be considered as stable disease (SD) and 5)<25% will be considered as no response (NR). Patients demonstrating a progression of disease will have their treatment discontinued but will be followed for an additional 12 weeks.

Total disappearance, and any reduction in size of the target metastatic tumors will indicate that the azurin treatment is effective for treating cancer. Other indications that the thioether cyclized p28 (SEQ ID NO: 13) treatment is effective are a decrease rate of in the appearance of new metastatic tumors and a decrease in the angiogenesis associated with tumors.

Various modifications and variations of the described examples and systems of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention which are obvious to those skilled in related fields are intended to be within the scope of the following embodiments.

Example 2-Example 18

Entry of p18 (SEQ ID NO: 14) and p28 (SEQ ID NO: 13) into Human Cell Lines

Cell Culture and Cell Lines: Human cancer and non-cancer (immortalized and non-immortalized) cell lines were obtained from ATCC [lung cancer (A549 and NCI-H23 adenocarcinoma), normal lung (CCD-13Lu), prostate cancers (DU145 and LN-CAP), normal prostate (CRL11611), breast cancer (MCF-7), normal breast (MCF-10A), colon cancer (HCT116), normal colon (CCD33Co), fibrosarcoma (HTI1080), and ovarian cancer (SK-OV3 adenocarcinoma)]. Normal fibroblasts isolated from skin were established. Normal ovarian cells (HOSE6-3) were donated by Dr. S. W. Tsao (University of Hong Kong). Melanoma lines (UISO-Mel-2, 23, 29) were established and characterized. All cells except UISO-Mel-2 were cultured in MEM-E (Invitrogen, Carlsbad, Calif.) supplemented with 10% heat-inactivated fetal bovine serum (Atlanta Biological Inc., Lawrenceville, Ga.), 100 units/ml penicillin and 100 μg/ml streptomycin at 37 C in 5% $CO_2$ or air.

Proliferation assays/Cell growth: Melanoma cells were seeded (four replicates) in flat bottom 24 well plates (Becton Dickinson, Franklin Lakes, N.J.) at a density of $12\times10^3$ cells/well. After 24 hrs media was changed and fresh p 18, p28 (SEQ ID NO: 13), azurin or a similar volume of media without peptide (eight replicates) added daily for 72 hr. Cells were then counted in a Beckman Coulter (Z 1 coulter particle counter). Values represent the mean±SD of 4 replicates.

MTT Assay: Melanoma cells were seeded at a density of 2000 cells/well in flat-bottomed 96 well plates (Becton Dickinson, Franklin Lakes, N.J.) and allowed to attach for 24 hrs. Freshly prepared peptide (10 μl) or culture medium was then added to each well. After 24 hrs, medium was changed and p18 (SEQ ID NO: 14), p28 (SEQ ID NO: 13) or azurin added daily. After 72 hr incubation, 10 μl of MTT reagent (Trevigen, Gaithersburg, Md.) was added to each well, the samples incubated for 3 hr, RT/sig 100 μl of detergent added to each well, and the samples incubated for an additional 3 hr at 37° C. Absorbance was measured with a SpectraMax 340 plate reader (Molecular Devices Corporation, Sunnyvale, Calif.) and percent change in the absorbance at 570 nm in treated cells relative to untreated controls determined. Values represent the mean±−SI). Significance between control and treated groups was determined by Student's t-test.

Peptide synthesis: All azurin derived peptides including p18, $Leu^{50}$-$Gly^{67}$ LSTAADMQGVVTDGMASG (SEQ ID NO. 14), p28 $Leu^{50}$-$Asp^{77}$ LSTAADMQGVVTDGMASGLDKDYLKPDD (SEQ ID NO. 13), p18b $Val^{60}$-$Asp^{77}$ VTDGMASGLDKDYLKPDD (SEQ ID NO: 3526), MAP, Mastoparan-7, and poly arginine (Arg-8, RRRRRRRR, SEQ ID NO: 3527) were synthesized by C S Bio, Inc. (Melo Park, CA.). Peptides were received as lyophilized powder aliquoted and stored at −20° C. in air-tight desiccators. All peptides were subsequently analyzed by mass spectrometry and reverse phase HPLC as >95% purity and mass balance.

Predictive modeling for azurin peptides: GENEITYX software (ver. 6.1) was used to generate Robson structure models for azurin derived peptides. Garnier, J., Osguthorpe, D. J., and Robson, B., J Mol Biol, 120: 97-120 (1978). The MAPAS Software was used to predict a given protein structure for strong membrane contacts and define regions of the protein surface that most likely form such contacts. Sharikov, Y. et al, Nat Methods, 5: 119 (2008). If a protein, i.e., azurin, has a membranephilic residue score (MRS)>3, membranephilic area score (MAS)>60%, and coefficient of membranephilic asymmetry ($K_{mpha}$)>2.5, there is a high probability that the protein has a true membrane-contacting region.

Peptide/Protein labeling: Peptides were dissolved in 1 ml PBS mixed with Alexafluor 568 dye (Molecular Probes, Eugene, Oreg.) at a 1:2 protein:dye ratio, 100 μl sodium bicarbonate added, and the mixture incubated overnight at 4° C. with continuous stirring. Labeled peptide was separated from free dye by dialyzing against cold-PBS using Slide-A-Lyzerg Dialysis Cassettes 1000 MWCO for p12 (SEQ ID NO: 3506) and 2000 MWCO for others (Pierce Biotechnology, Rockford, Ill.).

Cell penetration confocal analysis: Cells were seeded on glass coverslips and allowed to attach overnight at 37° C. under 5% $CO_2$. Cells were rinsed with fresh media and incubated at 37° C. for 2 hrs in pre-warmed media containing Alexafluor 568 labeled azurin peptides (20 μM) or Arg-8 (SEQ ID NO: 3527) (5 μM), or media alone. Following incubation, coverslips were rinsed 3× with PBS, cells fixed in 2.5% formalin for 5 min, and washed 2× in PBS, once in d.i. $H_2O$, and coverslips mounted in media containing 1.5 μg/ml DAPI for nuclear counter staining (VECTASHIELD® Vector Laboratories, Burlingame Calif.). Cellular uptake and distribution were photographed under an inverted confocal laser scanning microscope ('Model LC510, Carl Zeiss Inc., Gottingen, Germany).

Peptide co-localization with lysosomes or mitochondria was determined by incubating cells growing on a glass coverslip for 2 hrs at 37° with Alexafluor 568 labeled azurin or peptides. Mitrotracker (MitroTracker® Green FM Invitrogen Corporation, Carlsbad, Calif.) or lysotracker (LysoTracker® Green DND-26 Invitrogen Corporation, Carlsbad, Calif.) was added (final concentration 1 μM) for the last 30 mins of incubation. Cells were rinsed 3× with PBS, fixed in 2.5% formalin for 5 mins, washed 2× with PBS and incubated in 0.1% Triton-X100 in PBS for 15 min. Cells were then incubated with 1 μg/ml rabbit anti-human golgin 97 or anti-human caveolin I (Abcam, Cambridge, Mass.) in PBS with 1% BSA. After 1 hr incubation at 4° C., coverslips were washed once with PBS, incubated 10 min in PBS containing Alexafluor 468 conjugated goat anti-rabbit antibody, washed 2× in PBS and once in d.i.$H_2O$. Coverslips were then mounted in media containing 1.5 μg/mlDAPI for nuclear counter staining. Colocalization (yellow) of Alexafluor 568 (red) and Alexafluor 468 (green) was analyzed and photographed.

UISO-Mel-2 cells on coverslips were preincubated in MEM-E containing 100 μg/ml heparin sulfate (Sigma-Aldrich, St. Louis, Mo.) for 30 min and p18 (SEQ ID NO: 14), p28 (SEQ ID NO: 13) or Arg-8 (SEQ ID NO: 3527) added to bring the final concentration to 20 μM. After 1 hr, coverslips were washed, fixed, and analyzed as described above.

Cell penetration by FFACS: Cells ($1.0\times10^6$/500 μl PBS) were incubated for 2 hrs at 37° C. with Alexafluor 568 labeled p18 (SEQ ID NO: 14) or p28 (SEQ ID NO: 13) (20 μM), Arg-8 (SEQ ID NO: 3527) (5 μM), or media alone, washed 3× in PBS, fixed in 2.5% formalin for 5 min, washed twice in PBS, resuspended in 200 μl PBS, and passed through a screen to obtain a single cell suspension. Samples were analyzed with a MoFlo Cell Sorter (Dako, Glostrup, Denmark) $\lambda_{ex}$ 568 mm and $\lambda_{em}$ 603 nm and the fold increase of the mean fluorescence intensity over background levels calculated. Results represent mean fluorescence of three separate experiments.

Entry inhibitors: UISO-Mel-2 cells ($3\times10^5$ per 300 μl), maintained in phenol red-, serum-free MEM-E at 37° C., were pretreated with inhibitors, including: Chloropromazine (inhibitor of clathrin-mediated endocytosis, 10 μg/ml, 60 min); Amiloride (macropinocytosis inhibitor, 50 μM, 30 min); Nystatin (50 μg/ml, 30 min); Methyl-α-cyclodextrin (MβCD, 5 mM, 60 min); Filipin (inhibitor of caveolae-mediated endocytosis, 3 μg/ml, 60 min); Taxol (microtubule stabilizer, 20 μM, 30 min); Staurosporine (cell cycle inhibitor, 250 nM, 10 min); Sodium azide (metabolic inhibitor, 1 mM, 60 min); Oauabain (ATPase-dependent Na+/K+ pump inhibitor, 50 mM, 60 min); Brefeldin A (BFA; Golgi apparatus disrupter, 100 μM, 60 min); Wortmannin (early endosome inhibitor, 100 μM, 30 min); Monensin (inhibits at late endosome/lysosome, 10 μM, 60 min); Nocodazole (inhibits caveosome formation, 10 μM, 60 min); Cytochalasin D (actin filament and microtubule disruptor, 5 μM, 30 min); Benzyl 2-acetamido-2-deoxy-α-D-galactopyranoside (Bn-GalNac; O-linked glycosylation inhibitor, 3 mM, 48 hrs); Tunicamycin (N-linked glycosylation inhibitor, 20 μg/ml, 48 hrs); and Neuraminidase (cleave sialic acid residues from proteins, IU/ml, 30 min). Final concentrations were derived from the dose response curves of individual inhibitors. Alexafluor 568 labeled p18 (SEQ ID NO: 14) or p28 (SEQ ID NO: 13) (20 μM) were then added, incubated for 1 hr, and the cells washed, fixed and prepared for flow cytometric analysis as described above.

Cell Membrane Toxicity Assays/LDH Leakage Assay: An LDH leakage assay was performed according to the manufacturer's instructions (CytoTox-One, Promega, Wis.) with 100 μl of UISO-Mel-2 cells ($5\times10^3$). Cells without peptides/proteins were used as a negative control. Experiments were carried out in triplicate (data represent mean±SEM).

Hemolysis assay: Human whole blood samples (2-3 ml) were centrifuged for 10 min at 1000×g, and the pellets washed once with PBS and once with HKR buffer pH7.4 (18). Cell pellets were then resuspended in HKR buffer to 4% erythrocytes, 50 μl transferred to a 1.5 ml tube with 950 μl of peptides, azurin (5, 50 and 100 μM) or 0.1% Triton X-100 in HRK buffer to completely disrupt the RBC membrane. MAP and Mastoparan7 (Bachem California, Inc., Torrance, Calif.) were used as positive controls. After 30 min incubation at 37° C. with rotation, tubes were centrifuged for 2 min at 1000 xg, 300 μl of supernatants transferred to a 96-well plate and absorbance recorded at 540 mm.

Kinetics of Entry: UISO-Mel-2 cells ($5\times10^5$ cells) in 1.5 ml tubes were suspended in MEME media without phenol red. Reactions were started by adding either Alexa fluor 568-conjugated p18 at 0, 10, 20, 50, 100, 150 and 200 μM for 5, 10, 15 and 20 sec., or Alexafluor 568-conjugated p28 (SEQ ID NO: 13) at 1, 10, 25, 50, 100, 150 and 200 μM for 30, 60, 90 and 120 sec on ice. After incubation, 1 ml of cold-PBS was added to the 250 μl reaction in mixture. Cells were centrifuged twice at 600×g for 2 min at 4° C. At least 10,000 fixed cells were analyzed by flow cytometry in each reaction and their background and relative fluorescence calculated.

$I^{125}$ Labeling of Azurin and Competition Assays: Peptide binding and entry was determined using a whole cell assay with UISO-Mel-2 cells in HEPES solution (50,000 cells/ml), were incubated for 30 min at 37° C. with increasing concentrations (0-175 nM) of radiolabeled azurin in the presence/absence of 1000 fold excess of unlabeled p18 (SEQ ID NO: 14), p28 (SEQ ID NO: 13), or azurin, then washed 3 times with ice cold PBS, and radioactively remaining in the cell pellet counted using a gamma counter. Radioactivity in cells incubated with $^{125}I$ azurin alone was considered total binding; radioactivity in the presence of unlabeled azurin, p18 (SEQ ID NO: 14), or p28 (SEQ ID NO: 13) was considered nonspecific binding. Specific binding was determined by subtracting nonspecific binding from total binding and Scatchard plots generated.

Example 3

Figure 6A:
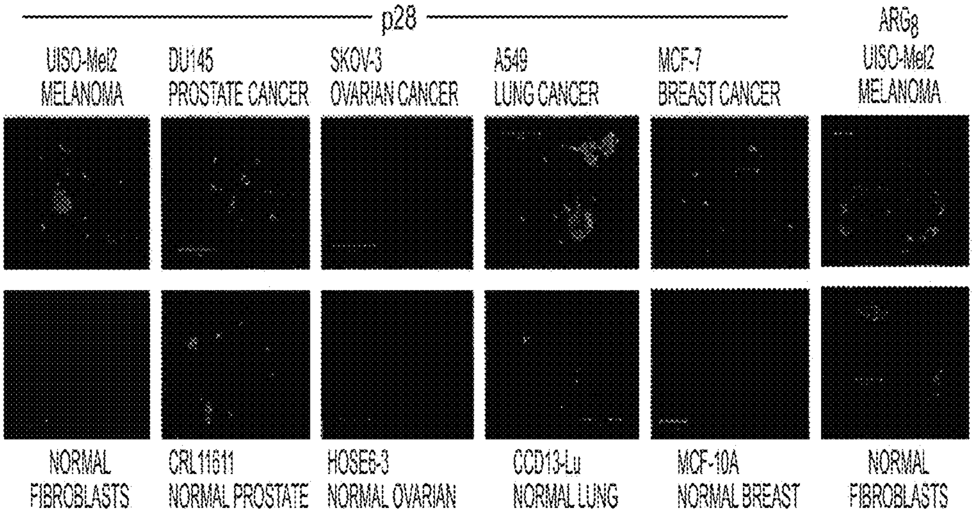
FIGS. 6A-6D.
Figure 6B:
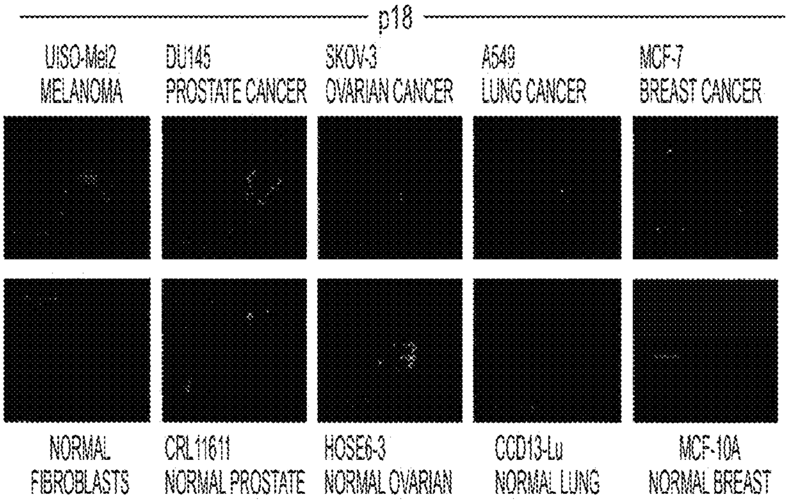

N-terminal Domain of p28 (SEQ ID NO: 13) Responsible for Preferential Entry into Cancer Cells Initial data from peptide-GST constructs defined amino acids 50-77 of azurin as a putative PTD for cell penetration, which fits well with structural evidence for an α-helical region encompassing residues 54-67 of azurin stabilizing the azurin molecule. Confocal analyses initially suggested that p28 (SEQ ID NO: 13) and p18 (SEQ ID NO: 14) of p28/azurin (FIGS. 6A and 6B) penetrated human melanoma, prostate, lung, breast and ovarian cancer cells with relatively similar efficiency, but did not penetrate histologically matched normal cell lines to the same degree (FIGS. 6A and 6B). A singular exception was CCD13-Lu, a cell line derived from lung fibroblasts. The cationic Arg-8 (SEQ ID NO: 3527) was rapidly and efficiently taken up into fibroblasts (FIGS. 6A and 6B) and all other normal cell lines tested (data not shown).

Figure 6C:
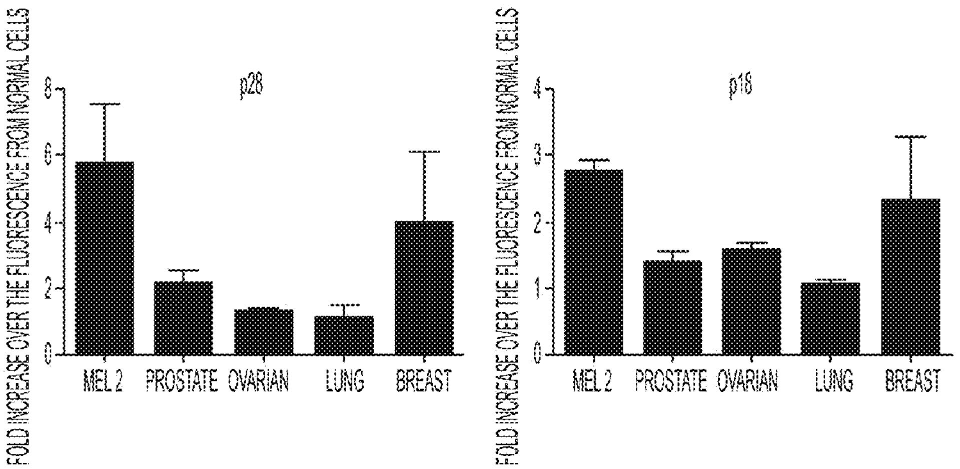
Figure 6D:
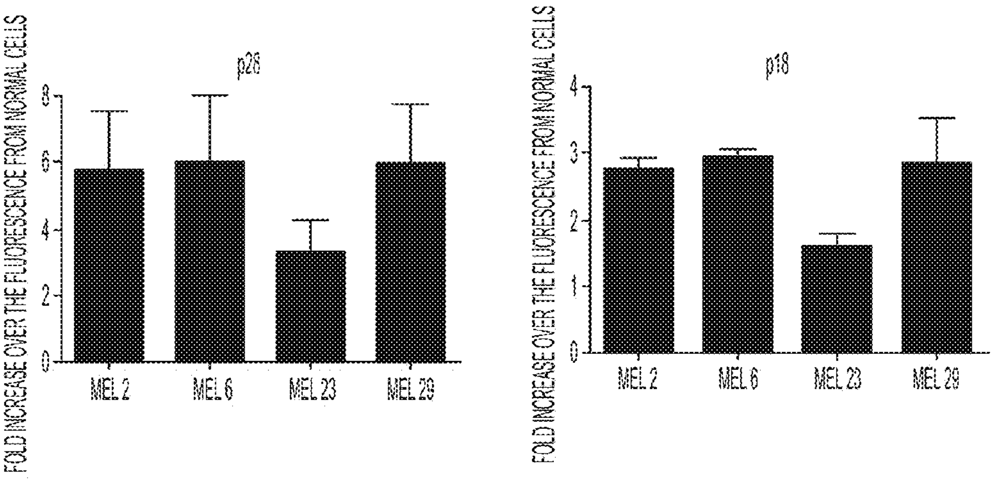

These observations were essentially confirmed by a more sensitive FACs analyses (FIG. 6C) where p28 (SEQ ID NO: 13) fluorescence was about 0.5-6 and p18 (SEQ ID NO: 14) about 0.5-3 fold higher than the corresponding normal cell line, with the exception of lung cancer. A similar pattern in intracellular fluorescence intensity was observed within a histopathologic subtype, melanoma, where the relative intensity of p18 (SEQ ID NO: 14) was about 50% of that observed with p28 (SEQ ID NO: 13) (FIG. 6D). Fluorescence intensity over background was also consistently lower in normal and cancer cell pairs exposed to p18 (SEQ ID NO: 14) than p28 (SEQ ID NO: 13) (data not shown), again suggesting less p18 entered individual cells. In all cases, the degree of entry of p18 (SEQ ID NO: 14) and p28 (SEQ ID NO: 13) into either cancer or normal cells was significantly less than that observed with Arg-8 (SEQ ID NO: 3527), where no preference for entry was observed (FIGS. 6A and 6B). The predicted Robson structure (data not shown) of p18 (SEQ ID NO: 14) suggests that the C-terminal amino acids form a partial β-sheet. This and the shorter length of p18 (SEQ ID NO: 14), which lacks the hydrophilic C-terminal 10 amino acids (amino acids 68-77) of p28 (SEQ ID NO: 13), suggests that p18 (SEQ ID NO: 14), as a putative PTD for azurin, may have a more rapid entry into cancer and normal cells via a non-endocytotic over an endocytotic or membrane receptor mediated process. MAPAS data (MRS 3.74, MAS 87.1, $K_{mpha}$ 2.37) predict that amino acids 69, 70, 75, 76, 85 of azurin provide the best opportunity for membrane contact, suggesting the C-terminal region of p28 (SEQ ID NO: 13), not present on p18 (SEQ ID NO: 14) (amino acids 50-67) is most likely to contact specific residues on the cell membrane, irrespective of a cell's status.

Figure 7A:
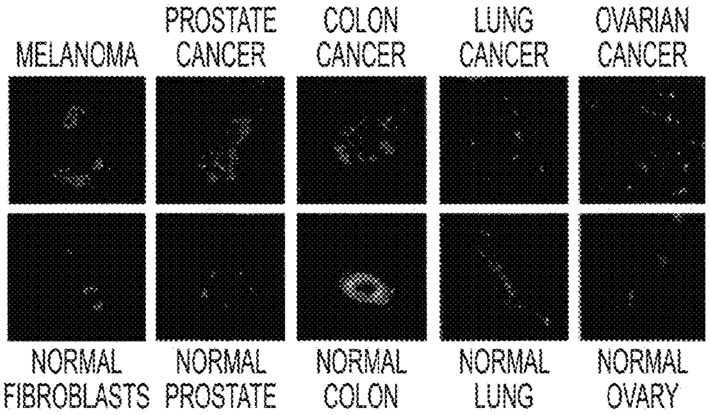
FIG. 7 (A) and (B). Depicts photographs showing entry of azu 60-77 (p18b) (SEQ ID NO: 3526) and azu 66-77 (p12) (SEQ ID NO: 3506) into cancer and normal cells. Cells were incubated with alexafluor 568 labeled p18b (SEQ II) NO: 3526) (A) or p12 (SEQ ID NO: 3506) (B) at 37° C. for 2 hrs and images recorded by confocal microscopy.
Figure 7B:
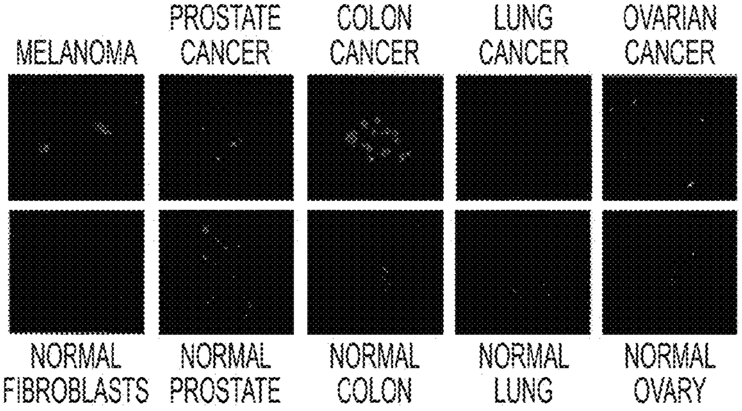

The preferential penetration of p 8 (SEQ ID NO: 14) and p28 (SEQ ID NO: 13) was confirmed by exposing the same cell lines to azurin 60-77 (p 18b), or amino acids 66-77 (p 12), the C-terminal 12 amino acids of p28 (SEQ ID NO: 13) (FIG. 7A, B). Here, the preferential penetration observed with p18 (SEQ ID NO: 14) and p28 (SEQ ID NO: 13) was completely abolished. p18b (SEQ ID NO: 3526) (theoretical pI 4.13) has a short α-helix and partial β-sheet, and is extremely hydrophilic which together may negate preferential entry. p12 (SEQ ID NO: 3506) (theoretical pI 4.33) lacks a secondary α-helical structure, but is also hydrophilic suggesting overall hydrophilicity may be a major contributor to the decrease in selectivity of cell penetration.

Example 4

Cell Penetration is not a Result of Membrane Disruption

Figure 8A:
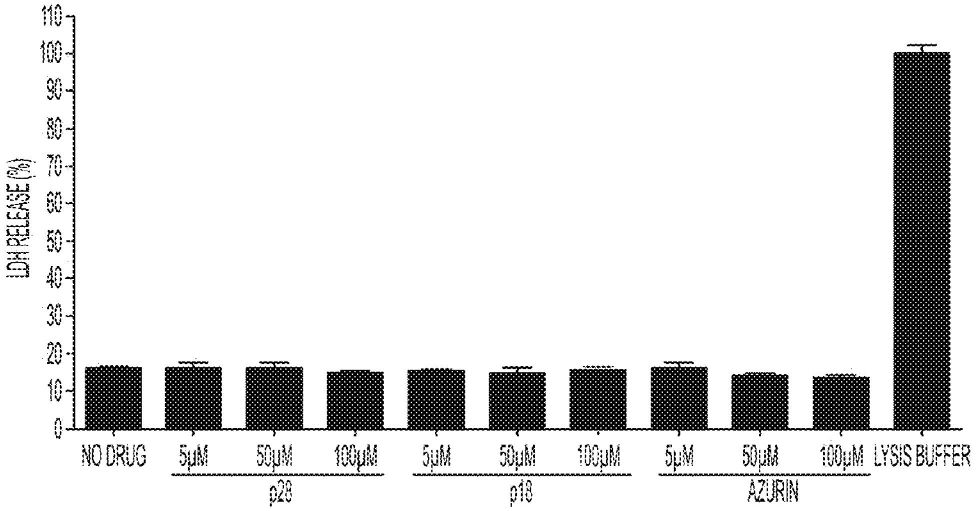
FIG. 8. Graphs depicting cellular membrane toxicity of azurin and its peptides. (A) LDH leakage assay of UISOMel-2 cells exposure for 10 min to different concentrations of p28 (SEQ ID NO: 13), p18 (SEQ ID NO: 14) and azurin at 37° C. A standard lysis buffer (cytotox-one reagent) was included as a positive control. Changes in fluorescence following exposure were measured at k,x 560 nm and kem 590 nm. Lysis buffer was defined as 100% LDH release. Data represent % of positive fluorescence of control. Data are shown as mean±SEM. (B) Hemoglobin leakage from human erythrocytes incubated with p28 (SEQ ID NO: 13), p18 (SEQ ID NO: 14) and azurin. Human erythrocytes were incubated with peptide for 30 min at 37° C. and absorbance at 540 nm determined. Hemoglobin release following 0.1%
Figure 8B:
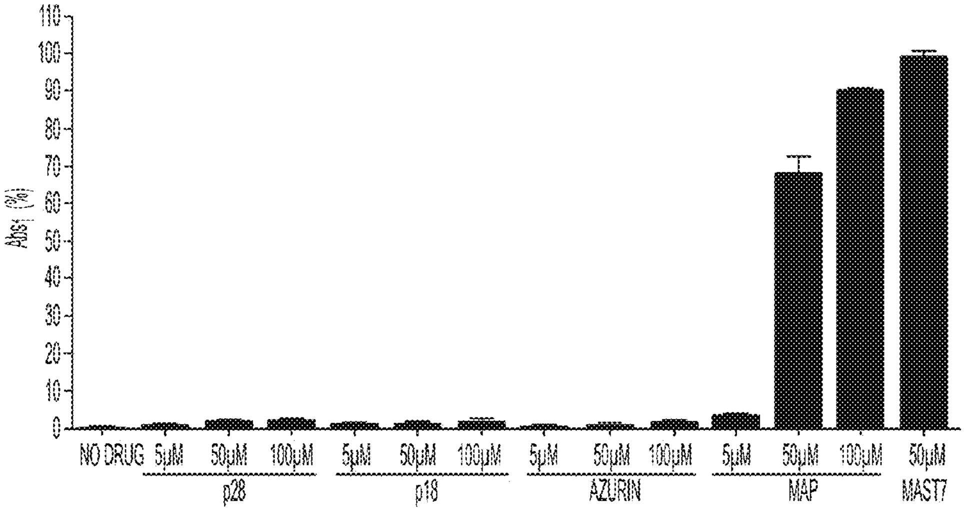
Figure 9A:
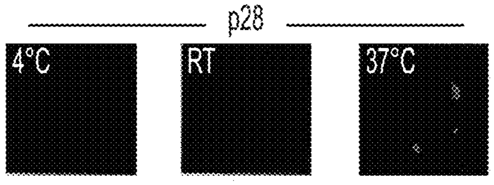
Figure 9B:
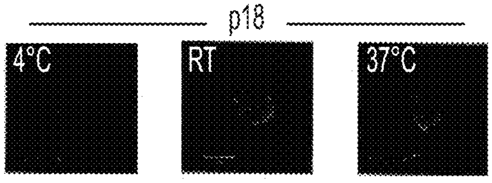
Figure 9C:
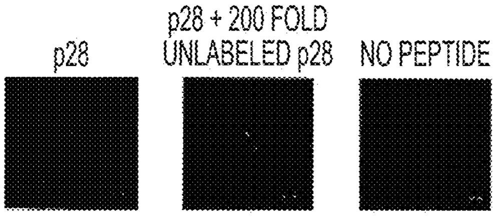
Figure 9D:
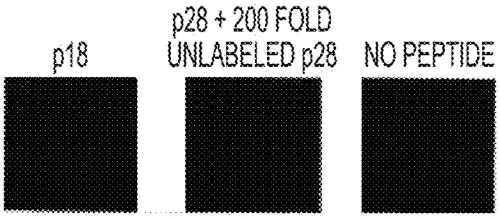

Cell penetration by azurin, p28 (SEQ ID NO: 13), and p18 (SEQ ID NO: 14) does not result from membrane disruption. An LDH leakage assay using UISO-Mel-2 cells in the presence of 5-100 μM p28 (SEQ ID NO: 13), p18 (SEQ ID NO: 14) or azurin (FIG. 8A) suggested that neither peptide nor azurin entered cells by altering plasma membrane integrity (18). The lack of membrane disruption was confirmed by determining the hemolytic activity of azurin, p28 (SEQ ID NO: 13), and p18 (SEQ ID NO: 14) on human erythrocytes against the receptor mimetic MAP and mast cell degranulating peptide mastoparan 7, which translocates cell membranes as an amphipathic alpha-helix, and activates heterotrimeric G proteins. Mastoparan 7 caused complete cell lysis at 25 μM, while azurin, p28 (SEQ ID NO: 13), and p18 (SEQ ID NO: 14) had no hemolytic effect when compared to control (no peptide) (FIG. 8B).

Example 5 p18/p28 Penetration is Energy Dependent and Saturable

The penetration of p28 (SEQ ID NO: 13) (FIG. 9A) and p18 (SEQ ID NO: 14) (FIG. 9B) into UISO-Mel-2 cells is temperature dependent. Cell penetration and intracellular transport occurs relatively slowly over 3 hr at 4° C., while entry and intracellular transport through various compartments is rapid at 22 and 37° C. as p18 (SEQ ID NO: 14) and p28 (SEQ ID NO: 13) were present in the nucleus of UISO-Mel-2 cells within 2 hrs post exposure. The penetration of 5 μM p28 (SEQ ID NO: 13) (FIG. 9C) or p18 (SEQ ID NO: 14) (FIG. 91)) into UISO-Mel-2 cells after 30 min in the presence of a 200 fold excess of unlabeled peptide was severely curtailed, suggesting that entry was a saturable process and specific receptors or cell surface proteins or specific residues were, at least in part, responsible for initial entry.

Example 6

Kinetics of p28 (SEQ ID NO: 13) and p18 (SEQ ID NO: 14)

The kinetics of p28 (SEQ ID NO: 13) and p18 (SEQ ID NO: 14) entry into UISO-Mel-2 cells relative to human fibroblasts was calculated after incubation, when cells were fixed and mean fluorescence intensity (MFI) determined. The Km and Vmax of each peptide were calculated by plotting peptide concentration (μM) vs. velocity (MFI/sec) or by Scatchard analysis. Although the penetration of azurin fragments 50-67 (p18: Vmax 2.46, Km 101.6) and 50-77 (p28: Vmax 1.87, Km 159.1) into cancer and normal cells (Vmax 2.88, Km 102.1 and Vmax 1.89, Km 166.0, respectively) differs significantly from each other, with p18 (SEQ ID NO: 14) entering −42% faster, the rate of the entry of each peptide into normal and cancer cells is virtually identical. The increase in amount of fluorescence following exposure of cancer cells to p28 (SEQ ID NO: 13) relative to p 18 is likely due to the increase in the amount of p28 (SEQ ID NO: 13) entering malignant cells. $^{125}$I azurin and p18 (SEQ ID NO: 14) bound to UISO-Mel-2 cells with a similar affinity. In contrast, significantly more p28 (SEQ ID NO: 13) ($K_d$ 2.5 μm, Bmax 3.0 pm) bound to UISO-Mel-2 cells with a higher affinity when exposed for a longer period of time (20 min vs. 2 min) at a higher temperature (37° C. vs. 4° C.) than either p18 (SEQ ID NO: 14) ($K_d$ 18 min, Bmax 0.51 pm) or azurin ($K_d$ 10 nm and 0.48 pm). These results suggest that azurin, p28 (SEQ ID NO: 13), and p18 (SEQ ID NO: 14) all bind with relatively high affinity and capacity to a site on the cancer and normal cell surface prior to entry, but may enter via more than one mechanism.

Example 7 p18/p28 Penetration Involves Caveolae and the Golgi Complex

Figure 10A:
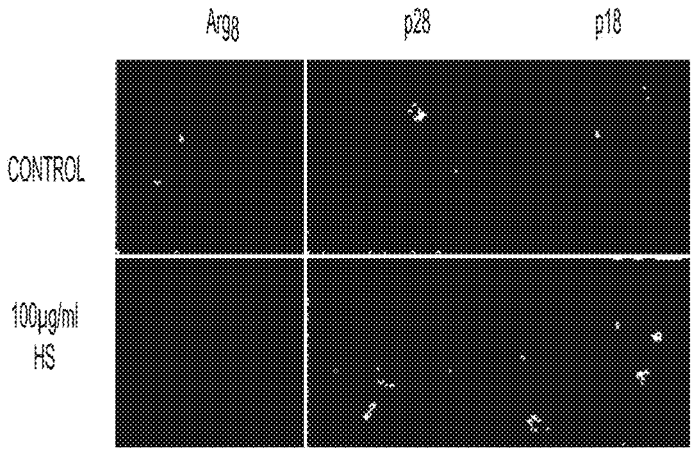

As a class, cationic CPPs such as pTat and Arg-8 (SEQ ID NO: 3527) enter cells by initially binding to anionic, sulfated proteoglycans prior to endocytosis. Incubation of p28 (SEQ ID NO: 13) and p18 (SEQ ID NO: 14) and Arg-8 (SEQ ID NO: 3527) with UISO-Mel-2 cells under serum free conditions in the presence/absence of 100 μg/ml heparin sulfite (HS) significantly reduced the amount of intracellular Arg-8 (SEQ ID NO: 3527), but did not alter the entry of either p28 (SEQ ID NO: 13) or p18 (SEQ ID NO: 14) (FIG. 10A). The penetration of p18 (SEQ ID NO: 14) and p28 (SEQ ID NO: 13) into UISO-Mel-2 cells in the presence or absence of a specific inhibitor of O-linked glycosylation, BnGalNac, and neruaminidase, which cleaves sialic acid residues, was further characterized (FIG. 10B), and no inhibition of penetration was observed. However, tunicamycin, an inhibitor of N-linked glycosylation, significantly reduced the penetration of p18 (SEQ ID NO: 14) and p28 (SEQ ID NO: 13) across the cell membrane.

Figure 10B:
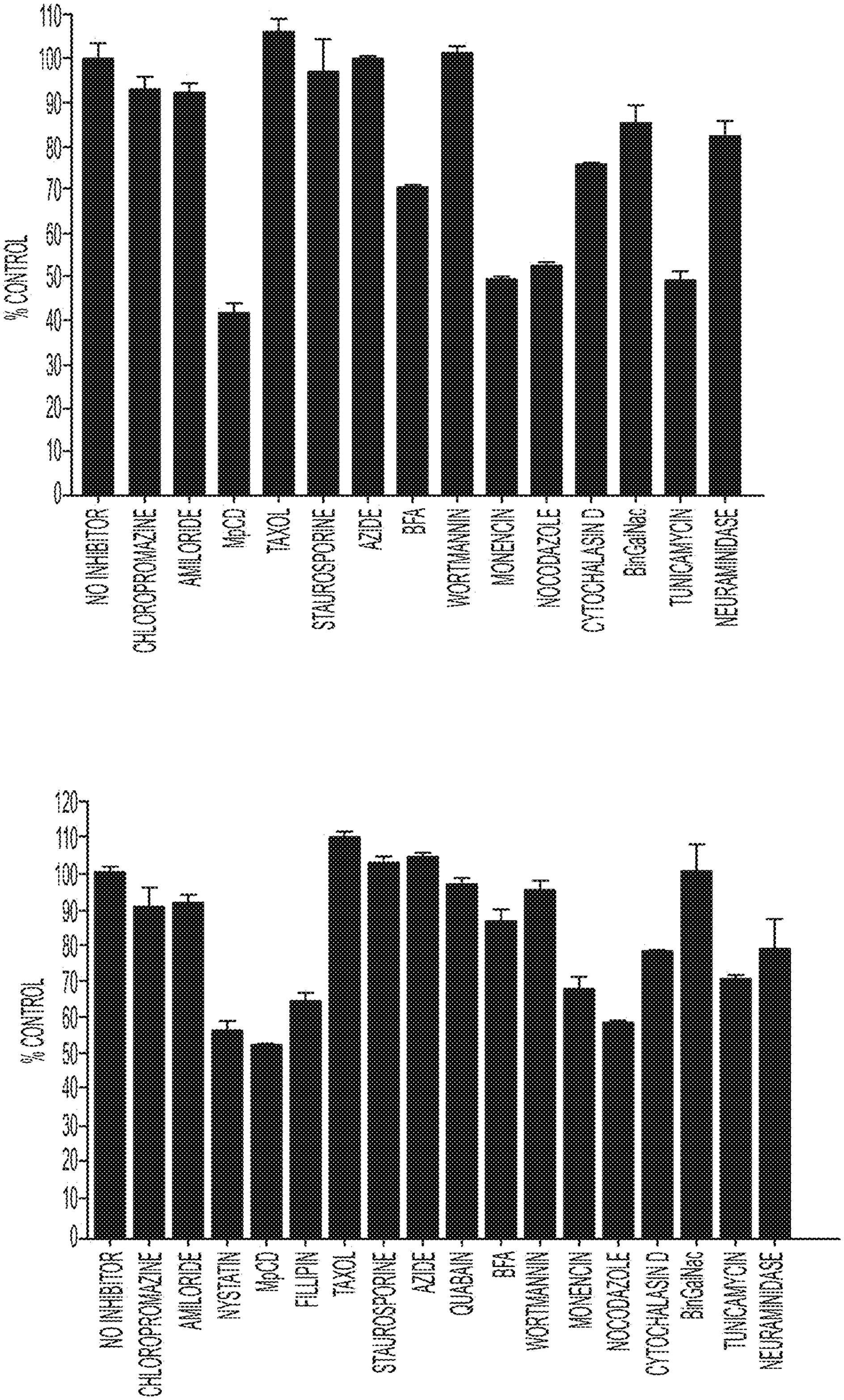

The entry of p18 (SEQ ID NO: 14) and p28 (SEQ ID NO: 13) into UISO-Mel-2 cells was also analyzed using inhibitors of energy dependent transport mechanisms, i.e., ATP. Sodium azide (FIG. 10B) and ouabain ($Na^+$ $K^+$ ATPase pump) did not significantly inhibit the penetration of either peptide suggesting non endocytotic pathways might also be involved in the penetration of these peptides. Chlorpromazine (CPZ), a specific inhibitor of clathrin mediated endocytosis, also had no effect on penetration, nor did the macropinocytosis inhibitor amiloride. (FIG. 10B). Stabilization of microtubules with taxol had no effect on penetration, but disruption of actin filaments and macropinocytosis with Cytochalasin D produced a small (−20%), reproducible inhibition of the penetration of p18 (SEQ ID NO: 14) and p28 (SEQ ID NO: 13). The lack of effect of amiloride suggests that the inhibitory activity of Cytochalasin D is probably through its effect on actin filaments.

Inhibition of the cell cycle with staurosporine did not block penetration, suggesting that penetration was not cell cycle specific. The lack of effect of staurosporine on p18 (SEQ ID NO: 14) and p28 (SEQ ID NO: 13) penetration of the cancer cell plasma membrane also suggests that a Src kinase/tyrosine kinase dependent pathway was not involved in penetration, was dynamin independent, and hence independent of caveolae budding. Neither p18 (SEQ ID NO: 14) nor p28 (SEQ ID NO: 13) co-localized with flotillin-1 (data not shown) a protein that resides within the plasma membrane and in a specific population of endocytic intermediates, again arguing against a role for flotillin and dynamin in internalization. In contrast, nocodazole, which disrupts caveolae transport and inhibitors of cholesterol mobilization and hence, caveolae-mediated endocytosis, inhibited penetration 50-65%.

The intracellular disposition of p18 (SEQ ID NO: 14) and p28 (SEQ ID NO: 13) was then analyzed using wortmannin, an inhibitor of early endosome formation, monensin, which inhibits late endosome/lysosome, and brefeldin A (BFA), a disrupter of the Golgi apparatus. Wortmannin did not block the intracellular accumulation of either p18 (SEQ ID NO: 14) or p28 (SEQ ID NO: 13) suggesting that, unlike cholera toxin, a caveolae to early endosome pathway is not involved in the intracellular trafficking of p18 (SEQ ID NO: 14) and p28 (SEQ ID NO: 13). The lack of early endosome involvement in the intracellular trafficking of p18 (SEQ ID NO: 14) and p28 (SEQ ID NO: 13) also suggests that clathrin mediated endocytosis is not involved in internalization of these peptides.

Figure 10C:
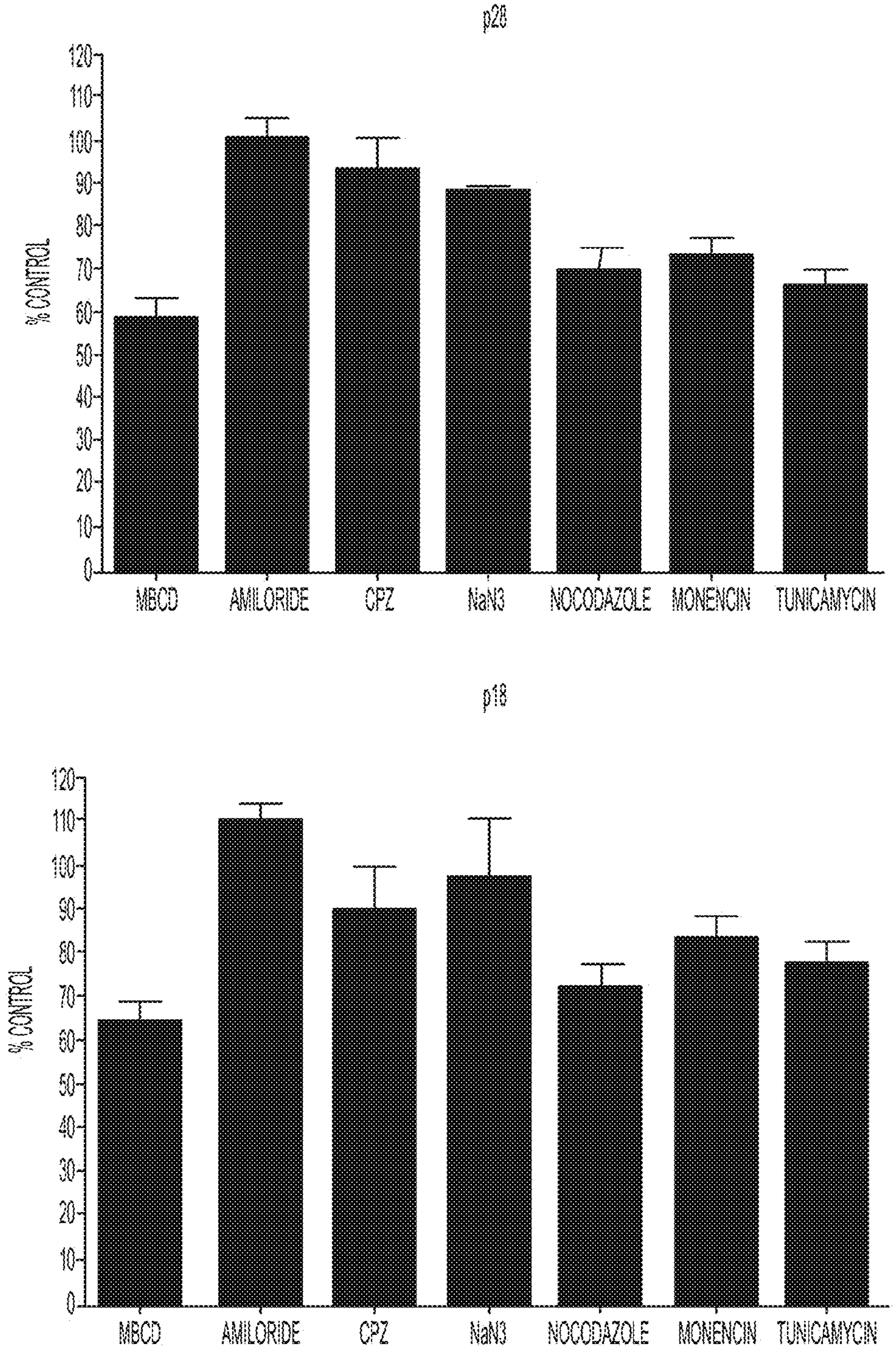
Figure 10D:
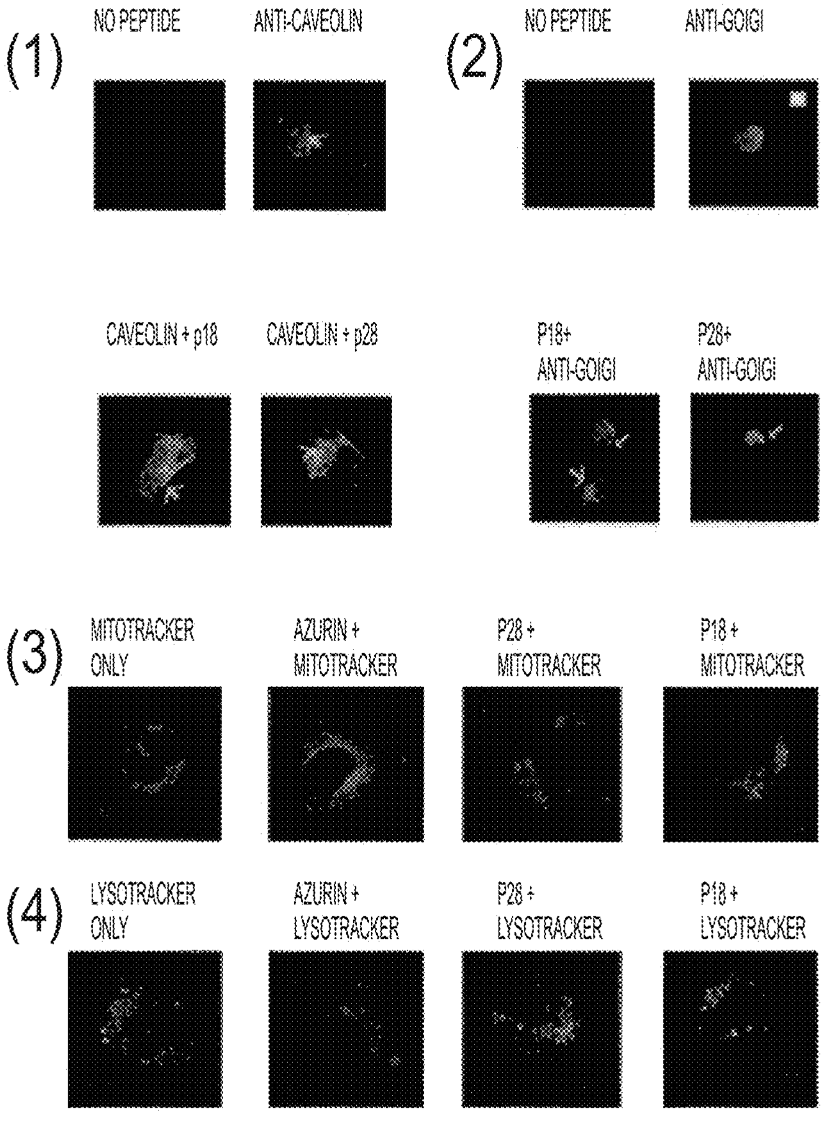

However, monensin (FIG. 10B) and BFA reduced the intracellular accumulation of both peptides with a greater inhibitory effect on p28 (SEQ ID NO: 13) (~30%) than p18 (SEQ ID NO: 14) (~10%) (FIG. 10B). The penetration of p28 (SEQ ID NO: 13) and p18 (SEQ ID NO: 14) into fibroblasts was also inhibited by MβCD, nocodazole, monensin and tunicarnycin, but not by amiloride, sodium azide, and CPZ (FIG. 10C). This suggests that at least one mechanism of entry into cancer and normal cells may be similar, but additional preferential accumulation into cancer cells may be a function of the number of common membrane receptors or structures, i.e., caveolae (FIG. 10D, panels 1,2). Alexafluor 568 labeled p18 (SEQ ID NO: 14) and p28 (SEQ ID NO: 13) co-localized with caveolin-1 and golgin 97 antibodies (FIG. 10D panels 1,2). This confirms that these organelles are involved in the intracellular trafficking of p18 (SEQ ID NO: 14) and p28 (SEQ ID NO: 13). Interestingly, azurin, but neither p18 (SEQ ID NO: 14) nor p28 (SEQ ID NO: 13) colocalized with mitochondrial specific fluorescence (FIG. 10D panel 3). In contrast, p28 (SEQ ID NO: 13) and azurin, but not p18 (SEQ ID NO: 14), co-localized with lysosomes (FIG. 101) panel 4).

Example 8

Functional Analysis of p28 (SEQ ID NO: 13) and p18 (SEQ ID NO: 14)

Azurin inhibits the growth of several human cancer cell lines in vitro and in vivo. FIGS. 11A and B illustrate the effect of p18 (SEQ ID NO: 14) and p28 (SEQ ID NO: 13) relative to azurin and dacarbazine (DTIC) on UISO-Mel-2 cells as determined by MTT and cell count. After 72 hrs exposure, azurin decreased ($p<0.05$) cell survival at 100 and 200 μM-15% (FIG. 11A). p28 (SEQ ID NO: 13) had inhibited cell survival 14 and 22% ($p<0.05$) at 100 and 200 μM, respectively. In contrast, p18 (SEQ ID NO: 14) had no effect, while dacarbazine (DTIC) produced a significant dose-related decrease on UISO-Mel-2 survival. Azurin and p28 (SEQ ID NO: 13) (200 μM) also significantly decreased the survival of UISO-Mel-23 and 29 cells. p18 (SEQ ID NO: 14) had no effect on UISO-Mel-2 cell proliferation. The apparent increase (~30-35%; UISO-Mel-2) in p28 (SEQ ID NO: 13) and azurin inhibition of melanoma cell proliferation, as measured by direct cell counting, suggests that the inhibitory effect may reside primarily at the level of cell cycle with apoptosis subsequent to any delay. Although p18 (SEQ ID NO: 14) penetrated cancer cells preferentially, unlike p28 (SEQ ID NO: 13), it had virtually no inhibitory activity on cell proliferation. This result demonstrates that the cytostatic and cytotoxic activity of p28 (SEQ ID NO: 13) lies in the C-terminal 10-12 amino acids of the sequence.

Example 9

Imaging p18 (SEQ ID NO: 14) and p28 (SEQ ID NO: 13) Entry Into Mouse Organs

Small animal in vivo imaging has important significance in biological studies, including human cancer research. The ability to track and visualize a tagged biological probe allows researchers to visualize biological processes and deduce mechanisms of action and efficacy. Imaging can be used to directly visualize trafficking of near infrared labeled peptides of the cupredoxin class of proteins, including azurin and the azurin fragments p28 (SEQ ID NO: 13) and p18 (SEQ ID NO: 14), to primary and metastatic tumor sites in xenograft bearing nude mice. J Biomed Optics 10:054010-1-11, 2005; J Amer Soc Exp Neuother 2:215-225, 2005; Topics Curr Chem 222:1-29, 2002.

Procedure. Athymic nude mice bearing Mel2 xenograft tumors were monitored until tumor size reached 0.5 $cm^3$. Mice were anesthetized using a mixture of 2:1 ketamine: xylazine; recommended dosage is 10 μl/gm mouse b.w. s.c. Anesthetized mice were scanned directly before and after injection of labeled peptide with an iCor Odyssey Imager. Anesthetized mice were injected i.v. (tail vein) with 100 μl of IRDye™ 800cw labeled p18/p28 at a concentration of 1.25 μg/μl-125 μg per mouse. Mice were scanned at least once every 24 hours until excess dye cleared their system (generally ~5 days). On the fifth day, mice were sacrificed and individual animals scanned a final time. Organs, including the kidneys, stomach, intestine, spleen, brain, heart, and lungs, and tumors were excised, split in half, and half were fixed for histological examination. The other half of the organs and tumors was covered with a small amount of PBS, and then scanned.

SEQUENCE LISTING (3531 sequences)

SEQ ID NO: 1-12 - skipped (12 entries)

SEQ ID NO: 13 - protein, 28 aa, Pseudomonas aeruginosa
LSTAADMQGVVTDGMASGLDKDYLKPDD

SEQ ID NO: 14 - protein, 18 aa, Pseudomonas aeruginosa
LSTAADMQGVVTDGMASG

SEQ ID NO: 15-18 - skipped (4 entries)

SEQ ID NO: 19 - protein, 17 aa, Pseudomonas aeruginosa
LSTAADMQGVVTDGMAS

SEQ ID NO: 20 - protein, 11 aa, Pseudomonas aeruginosa
GLDKDYLKPDD

SEQ ID NO: 21-23 - skipped (3 entries)

SEQ ID NO: 24 - protein, 18 aa, Pseudomonas aeruginosa
AADMQGVVTDGMASGLDK

SEQ ID NO: 25 - protein, 12 aa, Pseudomonas aeruginosa
AADMQGVVTDGM

SEQ ID NO: 26 - protein, 27 aa, Pseudomonas aeruginosa
STAADMQGVVTDGMASGLDKDYLKPDD

SEQ ID NO: 27-29 - skipped (3 entries)

SEQ ID NO: 30 - protein, 28 aa, Artificial Sequence
  Description of Artificial Sequence: Synthetic peptide
LSTAADMQAVVTDTMASGLDKDYLKPDD

SEQ ID NO: 31 - protein, 28 aa, Artificial Sequence
  Description of Artificial Sequence: Synthetic peptide
LSTAADLQGVVTDGLASGLDKDYLKPDD

SEQ ID NO: 32 - protein, 28 aa, Artificial Sequence
  Description of Artificial Sequence: Synthetic peptide
LSTAADVQGVVTDGVASGLDKDYLKPDD

SEQ ID NO: 33 - protein, 28 aa, Artificial Sequence
  Description of Artificial Sequence: Synthetic peptide
  N-term acetylated
  C-term amidated
LSTAADMQGVVTDGMASGLDKDYLKPDD

SEQ ID NO: 34 - protein, 28 aa, Artificial Sequence
  Description of Artificial Sequence: Synthetic peptide
LSWAADMQGVVTDGMASGLDKDYLKPDD

SEQ ID NO: 35 - protein, 28 aa, Artificial Sequence
  Description of Artificial Sequence: Synthetic peptide
LSTAADMWGVVTDGMASGLDKDYLKPDD

SEQ ID NO: 36 - protein, 28 aa, Artificial Sequence
  Description of Artificial Sequence: Synthetic peptide
LSTAADMQGVVWDGMASGLDKDYLKPDD

SEQ ID NO: 37 - protein, 28 aa, Artificial Sequence
  Description of Artificial Sequence: Synthetic peptide
LSTAADMQGVVTDWMASGLDKDYLKPDD

SEQ ID NO: 38 - protein, 28 aa, Artificial Sequence
  Description of Artificial Sequence: Synthetic peptide
LSWAADMWGVVTDGMASGLDKDYLKPDD

SEQ ID NO: 39 - protein, 28 aa, Artificial Sequence
  Description of Artificial Sequence: Synthetic peptide
LSWAADMQGVVWDGMASGLDKDYLKPDD

SEQ ID NO: 40 - protein, 28 aa, Artificial Sequence
  Description of Artificial Sequence: Synthetic peptide
LSWAADMQGVVTDWMASGLDKDYLKPDD

SEQ ID NO: 41 - protein, 28 aa, Artificial Sequence
  Description of Artificial Sequence: Synthetic peptide
LSTAADMWGVVWDGMASGLDKDYLKPDD

SEQ ID NO: 42 - protein, 28 aa, Artificial Sequence
  Description of Artificial Sequence: Synthetic peptide
LSTAADMWGVVTDWMASGLDKDYLKPDD

SEQ ID NO: 43 - protein, 28 aa, Artificial Sequence
  Description of Artificial Sequence: Synthetic peptide
LSTAADMQGVVWDWMASGLDKDYLKPDD

SEQ ID NO: 44 - protein, 28 aa, Artificial Sequence
  Description of Artificial Sequence: Synthetic peptide
LSWAADMWGVVWDWMASGLDKDYLKPDD

SEQ ID NO: 45 - protein, 28 aa, Artificial Sequence
  Description of Artificial Sequence: Synthetic peptide
DDPKLYDKDLGSAMGDTVVGQMDAATSL

SEQ ID NO: 46 - protein, 16 aa, Artificial Sequence
  Description of Artificial Sequence: Synthetic peptide
  MOD_RES (3)..(7): Any amino acid
  MOD_RES (9)..(10): Any amino acid
  MOD_RES (12)..(12): Any amino acid
  MOD_RES (14)..(15): Any amino acid
DGXXXXXDXXYXKXXD

SEQ ID NO: 47 - protein, 15 aa, Artificial Sequence
  Description of Artificial Sequence: Synthetic peptide
  MOD_RES (3)..(6): Any amino acid
  MOD_RES (8)..(9): Any amino acid
  MOD_RES (11)..(11): Any amino acid
  MOD_RES (13)..(14): Any amino acid
DGXXXXDXXYXKXXD

SEQ ID NO: 48 - protein, 28 aa, Artificial Sequence
  Description of Artificial Sequence: Synthetic peptide
  MOD_RES (1)..(1): Leu or acetylated-Leu
  MOD_RES (3)..(3): Thr or Trp
  MOD_RES (7)..(7): Met, Leu or Val
  MOD_RES (8)..(8): Gln or Trp
  MOD_RES (9)..(9): Gly or Ala
  MOD_RES (12)..(12): Thr or Trp
  MOD_RES (14)..(14): Gly, Thr or Trp
  MOD_RES (15)..(15): Met, Leu or Val
  MOD_RES (28)..(28): Asp or amidated-Asp
XSXAADXXXVVXDXXASGLDKDYLKPDX

SEQ ID NO: 49 - protein, 28 aa, Artificial Sequence
  Description of Artificial Sequence: Synthetic peptide
  MOD_RES (1)..(1): Asp or acetylated-Asp
  MOD_RES (14)..(14): Met, Leu or Val
  MOD_RES (15)..(15): Gly, Thr or Trp
  MOD_RES (17)..(17): Thr or Trp
  MOD_RES (20)..(20): Gly or Ala
  MOD_RES (21)..(21): Gln or Trp
  MOD_RES (22)..(22): Met, Leu or Val
  MOD_RES (26)..(26): Thr or Trp
  MOD_RES (28)..(28): Leu or amidated-Leu
XDPKLYDKDLGSAXXDXVVXXXDAAXSX

SEQ ID NO: 50 - protein, 28 aa, Artificial Sequence
  Description of Artificial Sequence: Synthetic peptide
  N-term acetylated
LSTAADMQGVVTDGMASGLDKDYLKPDD

SEQ ID NO: 51 - protein, 28 aa, Artificial Sequence
  Description of Artificial Sequence: Synthetic peptide
LSWAADMQGVVTDGMASGLDKDYLKPDD

SEQ ID NO: 52 - protein, 28 aa, Artificial Sequence
  Description of Artificial Sequence: Synthetic peptide
  N-term acetylated
LSWAADMQGVVTDGMASGLDKDYLKPDD

SEQ ID NO: 53 - protein, 28 aa, Artificial Sequence
  Description of Artificial Sequence: Synthetic peptide
LSTAADLQGVVTDGMASGLDKDYLKPDD

SEQ ID NO: 54 - protein, 28 aa, Artificial Sequence
  Description of Artificial Sequence: Synthetic peptide
  N-term acetylated
LSTAADLQGVVTDGMASGLDKDYLKPDD

SEQ ID NO: 55 - protein, 28 aa, Artificial Sequence
  Description of Artificial Sequence: Synthetic peptide
LSWAADLQGVVTDGMASGLDKDYLKPDD

SEQ ID NO: 56 - protein, 28 aa, Artificial Sequence
  Description of Artificial Sequence: Synthetic peptide
  N-term acetylated
LSWAADLQGVVTDGMASGLDKDYLKPDD

SEQ ID NO: 57 - protein, 28 aa, Artificial Sequence
  Description of Artificial Sequence: Synthetic peptide
LSTAADVQGVVTDGMASGLDKDYLKPDD

SEQ ID NO: 58 - protein, 28 aa, Artificial Sequence
  Description of Artificial Sequence: Synthetic peptide
  N-term acetylated
LSTAADVQGVVTDGMASGLDKDYLKPDD

SEQ ID NO: 59 - protein, 28 aa, Artificial Sequence
  Description of Artificial Sequence: Synthetic peptide
LSWAADVQGVVTDGMASGLDKDYLKPDD

SEQ ID NO: 60 - protein, 28 aa, Artificial Sequence
  Description of Artificial Sequence: Synthetic peptide
  N-term acetylated
LSWAADVQGVVTDGMASGLDKDYLKPDD

SEQ ID NO: 61 - protein, 28 aa, Artificial Sequence
  Description of Artificial Sequence: Synthetic peptide
LSTAADMWGVVTDGMASGLDKDYLKPDD

SEQ ID NO: 62 - protein, 28 aa, Artificial Sequence
  Description of Artificial Sequence: Synthetic peptide
  N-term acetylated
LSTAADMWGVVTDGMASGLDKDYLKPDD

SEQ ID NO: 63 - protein, 28 aa, Artificial Sequence
  Description of Artificial Sequence: Synthetic peptide
LSWAADMWGVVTDGMASGLDKDYLKPDD

SEQ ID NO: 64 - protein, 28 aa, Artificial Sequence
  Description of Artificial Sequence: Synthetic peptide
  N-term acetylated
LSWAADMWGVVTDGMASGLDKDYLKPDD

SEQ ID NO: 65 - protein, 28 aa, Artificial Sequence
  Description of Artificial Sequence: Synthetic peptide
LSTAADLWGVVTDGMASGLDKDYLKPDD

SEQ ID NO: 66 - protein, 28 aa, Artificial Sequence
  Description of Artificial Sequence: Synthetic peptide
  N-term acetylated
LSTAADLWGVVTDGMASGLDKDYLKPDD

SEQ ID NO: 67 - protein, 28 aa, Artificial Sequence
  Description of Artificial Sequence: Synthetic peptide
LSWAADLWGVVTDGMASGLDKDYLKPDD

SEQ ID NO: 68 - protein, 28 aa, Artificial Sequence
  Description of Artificial Sequence: Synthetic peptide
  N-term acetylated
LSWAADLWGVVTDGMASGLDKDYLKPDD

SEQ ID NO: 69 - protein, 28 aa, Artificial Sequence
  Description of Artificial Sequence: Synthetic peptide
LSTAADVWGVVTDGMASGLDKDYLKPDD

SEQ ID NO: 70 - protein, 28 aa, Artificial Sequence
  Description of Artificial Sequence: Synthetic peptide
  N-term acetylated
LSTAADVWGVVTDGMASGLDKDYLKPDD

SEQ ID NO: 71 - protein, 28 aa, Artificial Sequence
  Description of Artificial Sequence: Synthetic peptide
LSWAADVWGVVTDGMASGLDKDYLKPDD

SEQ ID NO: 72 - protein, 28 aa, Artificial Sequence
  Description of Artificial Sequence: Synthetic peptide
  N-term acetylated
LSWAADVWGVVTDGMASGLDKDYLKPDD

SEQ ID NO: 73 - protein, 28 aa, Artificial Sequence
  Description of Artificial Sequence: Synthetic peptide
LSTAADMQAVVTDGMASGLDKDYLKPDD

SEQ ID NO: 74 - protein, 28 aa, Artificial Sequence
  Description of Artificial Sequence: Synthetic peptide
  N-term acetylated
LSTAADMQAVVTDGMASGLDKDYLKPDD

SEQ ID NO: 75 - protein, 28 aa, Artificial Sequence
  Description of Artificial Sequence: Synthetic peptide
LSWAADMQAVVTDGMASGLDKDYLKPDD

SEQ ID NO: 76 - protein, 28 aa, Artificial Sequence
  Description of Artificial Sequence: Synthetic peptide
  N-term acetylated
LSWAADMQAVVTDGMASGLDKDYLKPDD

SEQ ID NO: 77 - protein, 28 aa, Artificial Sequence
  Description of Artificial Sequence: Synthetic peptide
LSTAADLQAVVTDGMASGLDKDYLKPDD

SEQ ID NO: 78 - protein, 28 aa, Artificial Sequence
  Description of Artificial Sequence: Synthetic peptide
  N-term acetylated
LSTAADLQAVVTDGMASGLDKDYLKPDD

SEQ ID NO: 79 - protein, 28 aa, Artificial Sequence
  Description of Artificial Sequence: Synthetic peptide
LSWAADLQAVVTDGMASGLDKDYLKPDD

SEQ ID NO: 80 - protein, 28 aa, Artificial Sequence
  Description of Artificial Sequence: Synthetic peptide
  N-term acetylated
LSWAADLQAVVTDGMASGLDKDYLKPDD

SEQ ID NO: 81 - protein, 28 aa, Artificial Sequence
  Description of Artificial Sequence: Synthetic peptide
LSTAADVQAVVTDGMASGLDKDYLKPDD

SEQ ID NO: 82 - protein, 28 aa, Artificial Sequence
  Description of Artificial Sequence: Synthetic peptide
  N-term acetylated
LSTAADVQAVVTDGMASGLDKDYLKPDD

SEQ ID NO: 83 - protein, 28 aa, Artificial Sequence
  Description of Artificial Sequence: Synthetic peptide
LSWAADVQAVVTDGMASGLDKDYLKPDD

SEQ ID NO: 84 - protein, 28 aa, Artificial Sequence
  Description of Artificial Sequence: Synthetic peptide
  N-term acetylated
LSWAADVQAVVTDGMASGLDKDYLKPDD

SEQ ID NO: 85 - protein, 28 aa, Artificial Sequence
  Description of Artificial Sequence: Synthetic peptide
LSTAADMWAVVTDGMASGLDKDYLKPDD

SEQ ID NO: 86 - protein, 28 aa, Artificial Sequence
  Description of Artificial Sequence: Synthetic peptide
  N-term acetylated
LSTAADMWAVVTDGMASGLDKDYLKPDD

SEQ ID NO: 87 - protein, 28 aa, Artificial Sequence
  Description of Artificial Sequence: Synthetic peptide
LSWAADMWAVVTDGMASGLDKDYLKPDD

SEQ ID NO: 88 - protein, 28 aa, Artificial Sequence
  Description of Artificial Sequence: Synthetic peptide
  N-term acetylated
LSWAADMWAVVTDGMASGLDKDYLKPDD

SEQ ID NO: 89 - protein, 28 aa, Artificial Sequence
  Description of Artificial Sequence: Synthetic peptide
LSTAADLWAVVTDGMASGLDKDYLKPDD

SEQ ID NO: 90 - protein, 28 aa, Artificial Sequence
  Description of Artificial Sequence: Synthetic peptide
  N-term acetylated
LSTAADLWAVVTDGMASGLDKDYLKPDD

SEQ ID NO: 91 - protein, 28 aa, Artificial Sequence
  Description of Artificial Sequence: Synthetic peptide
LSWAADLWAVVTDGMASGLDKDYLKPDD

SEQ ID NO: 92 - protein, 28 aa, Artificial Sequence
  Description of Artificial Sequence: Synthetic peptide
  N-term acetylated
LSWAADLWAVVTDGMASGLDKDYLKPDD

SEQ ID NO: 93 - protein, 28 aa, Artificial Sequence
  Description of Artificial Sequence: Synthetic peptide
LSTAADVWAVVTDGMASGLDKDYLKPDD

SEQ ID NO: 94 - protein, 28 aa, Artificial Sequence
  Description of Artificial Sequence: Synthetic peptide
  N-term acetylated
LSTAADVWAVVTDGMASGLDKDYLKPDD

SEQ ID NO: 95 - protein, 28 aa, Artificial Sequence
  Description of Artificial Sequence: Synthetic peptide
LSWAADVWAVVTDGMASGLDKDYLKPDD

SEQ ID NO: 96 - protein, 28 aa, Artificial Sequence
  Description of Artificial Sequence: Synthetic peptide
  N-term acetylated
LSWAADVWAVVTDGMASGLDKDYLKPDD

SEQ ID NO: 97 - protein, 28 aa, Artificial Sequence
  Description of Artificial Sequence: Synthetic peptide
LSTAADMQGVVWDGMASGLDKDYLKPDD

SEQ ID NO: 98 - protein, 28 aa, Artificial Sequence
  Description of Artificial Sequence: Synthetic peptide
  N-term acetylated
LSTAADMQGVVWDGMASGLDKDYLKPDD

SEQ ID NO: 99 - protein, 28 aa, Artificial Sequence
  Description of Artificial Sequence: Synthetic peptide
LSWAADMQGVVWDGMASGLDKDYLKPDD

SEQ ID NO: 100 - protein, 28 aa, Artificial Sequence
  Description of Artificial Sequence: Synthetic peptide
  N-term acetylated
LSWAADMQGVVWDGMASGLDKDYLKPDD

SEQ ID NO: 101 - protein, 28 aa, Artificial Sequence
  Description of Artificial Sequence: Synthetic peptide
LSTAADLQGVVWDGMASGLDKDYLKPDD

SEQ ID NO: 102 - protein, 28 aa, Artificial Sequence
  Description of Artificial Sequence: Synthetic peptide
  N-term acetylated
LSTAADLQGVVWDGMASGLDKDYLKPDD

SEQ ID NO: 103 - protein, 28 aa, Artificial Sequence
  Description of Artificial Sequence: Synthetic peptide
LSWAADLQGVVWDGMASGLDKDYLKPDD

SEQ ID NO: 104 - protein, 28 aa, Artificial Sequence
  Description of Artificial Sequence: Synthetic peptide
  N-term acetylated
LSWAADLQGVVWDGMASGLDKDYLKPDD

SEQ ID NO: 105 - protein, 28 aa, Artificial Sequence
  Description of Artificial Sequence: Synthetic peptide
LSTAADVQGVVWDGMASGLDKDYLKPDD

SEQ ID NO: 106 - protein, 28 aa, Artificial Sequence
  Description of Artificial Sequence: Synthetic peptide
  N-term acetylated
LSTAADVQGVVWDGMASGLDKDYLKPDD

SEQ ID NO: 107 - protein, 28 aa, Artificial Sequence
  Description of Artificial Sequence: Synthetic peptide
LSWAADVQGVVWDGMASGLDKDYLKPDD

SEQ ID NO: 108 - protein, 28 aa, Artificial Sequence
  Description of Artificial Sequence: Synthetic peptide
  N-term acetylated
LSWAADVQGVVWDGMASGLDKDYLKPDD

SEQ ID NO: 109 - protein, 28 aa, Artificial Sequence
  Description of Artificial Sequence: Synthetic peptide
LSTAADMWGVVWDGMASGLDKDYLKPDD

SEQ ID NO: 110 - protein, 28 aa, Artificial Sequence
  Description of Artificial Sequence: Synthetic peptide
  N-term acetylated
LSTAADMWGVVWDGMASGLDKDYLKPDD

SEQ ID NO: 111 - protein, 28 aa, Artificial Sequence
  Description of Artificial Sequence: Synthetic peptide
LSWAADMWGVVWDGMASGLDKDYLKPDD

SEQ ID NO: 112 - protein, 28 aa, Artificial Sequence
  Description of Artificial Sequence: Synthetic peptide
  N-term acetylated
LSWAADMWGVVWDGMASGLDKDYLKPDD

SEQ ID NO: 113 - protein, 28 aa, Artificial Sequence
  Description of Artificial Sequence: Synthetic peptide
LSTAADLWGVVWDGMASGLDKDYLKPDD

SEQ ID NO: 114 - protein, 28 aa, Artificial Sequence
  Description of Artificial Sequence: Synthetic peptide
  N-term acetylated
LSTAADLWGVVWDGMASGLDKDYLKPDD

SEQ ID NO: 115 - protein, 28 aa, Artificial Sequence
  Description of Artificial Sequence: Synthetic peptide
LSWAADLWGVVWDGMASGLDKDYLKPDD

SEQ ID NO: 116 - protein, 28 aa, Artificial Sequence
  Description of Artificial Sequence: Synthetic peptide
  N-term acetylated
LSWAADLWGVVWDGMASGLDKDYLKPDD

SEQ ID NO: 117 - protein, 28 aa, Artificial Sequence
  Description of Artificial Sequence: Synthetic peptide
LSTAADVWGVVWDGMASGLDKDYLKPDD

SEQ ID NO: 118 - protein, 28 aa, Artificial Sequence
  Description of Artificial Sequence: Synthetic peptide
  N-term acetylated
LSTAADVWGVVWDGMASGLDKDYLKPDD

SEQ ID NO: 119 - protein, 28 aa, Artificial Sequence
  Description of Artificial Sequence: Synthetic peptide
LSWAADVWGVVWDGMASGLDKDYLKPDD

SEQ ID NO: 120 - protein, 28 aa, Artificial Sequence
  Description of Artificial Sequence: Synthetic peptide
  N-term acetylated
LSWAADVWGVVWDGMASGLDKDYLKPDD

SEQ ID NO: 121 - protein, 28 aa, Artificial Sequence
  Description of Artificial Sequence: Synthetic peptide
LSTAADMQAVVWDGMASGLDKDYLKPDD

SEQ ID NO: 122 - protein, 28 aa, Artificial Sequence
  Description of Artificial Sequence: Synthetic peptide
  N-term acetylated
LSTAADMQAVVWDGMASGLDKDYLKPDD

SEQ ID NO: 123 - protein, 28 aa, Artificial Sequence
  Description of Artificial Sequence: Synthetic peptide
LSWAADMQAVVWDGMASGLDKDYLKPDD

SEQ ID NO: 124 - protein, 28 aa, Artificial Sequence
  Description of Artificial Sequence: Synthetic peptide
  N-term acetylated
LSWAADMQAVVWDGMASGLDKDYLKPDD

SEQ ID NO: 125 - protein, 28 aa, Artificial Sequence
  Description of Artificial Sequence: Synthetic peptide
LSTAADLQAVVWDGMASGLDKDYLKPDD

SEQ ID NO: 126 - protein, 28 aa, Artificial Sequence
  Description of Artificial Sequence: Synthetic peptide
  N-term acetylated
LSTAADLQAVVWDGMASGLDKDYLKPDD

SEQ ID NO: 127 - protein, 28 aa, Artificial Sequence
  Description of Artificial Sequence: Synthetic peptide
LSWAADLQAVVWDGMASGLDKDYLKPDD

SEQ ID NO: 128 - protein, 28 aa, Artificial Sequence
  Description of Artificial Sequence: Synthetic peptide
  N-term acetylated
LSWAADLQAVVWDGMASGLDKDYLKPDD

SEQ ID NO: 129 - protein, 28 aa, Artificial Sequence
  Description of Artificial Sequence: Synthetic peptide
LSTAADVQAVVWDGMASGLDKDYLKPDD

SEQ ID NO: 130 - protein, 28 aa, Artificial Sequence
  Description of Artificial Sequence: Synthetic peptide
  N-term acetylated
LSTAADVQAVVWDGMASGLDKDYLKPDD

SEQ ID NO: 131 - protein, 28 aa, Artificial Sequence
  Description of Artificial Sequence: Synthetic peptide
LSWAADVQAVVWDGMASGLDKDYLKPDD

SEQ ID NO: 132 - protein, 28 aa, Artificial Sequence
  Description of Artificial Sequence: Synthetic peptide
  N-term acetylated
LSWAADVQAVVWDGMASGLDKDYLKPDD

SEQ ID NO: 133 - protein, 28 aa, Artificial Sequence
  Description of Artificial Sequence: Synthetic peptide
LSTAADMWAVVWDGMASGLDKDYLKPDD

SEQ ID NO: 134 - protein, 28 aa, Artificial Sequence
  Description of Artificial Sequence: Synthetic peptide
  N-term acetylated
LSTAADMWAVVWDGMASGLDKDYLKPDD

SEQ ID NO: 135 - protein, 28 aa, Artificial Sequence
  Description of Artificial Sequence: Synthetic peptide
LSWAADMWAVVWDGMASGLDKDYLKPDD

SEQ ID NO: 136 - protein, 28 aa, Artificial Sequence
  Description of Artificial Sequence: Synthetic peptide
  N-term acetylated
LSWAADMWAVVWDGMASGLDKDYLKPDD

SEQ ID NO: 137 - protein, 28 aa, Artificial Sequence
  Description of Artificial Sequence: Synthetic peptide
LSTAADLWAVVWDGMASGLDKDYLKPDD

SEQ ID NO: 138 - protein, 28 aa, Artificial Sequence
  Description of Artificial Sequence: Synthetic peptide
  N-term acetylated
LSTAADLWAVVWDGMASGLDKDYLKPDD

SEQ ID NO: 139 - protein, 28 aa, Artificial Sequence
  Description of Artificial Sequence: Synthetic peptide
LSWAADLWAVVWDGMASGLDKDYLKPDD

SEQ ID NO: 140 - protein, 28 aa, Artificial Sequence
  Description of Artificial Sequence: Synthetic peptide
  N-term acetylated
LSWAADLWAVVWDGMASGLDKDYLKPDD

SEQ ID NO: 141 - protein, 28 aa, Artificial Sequence
  Description of Artificial Sequence: Synthetic peptide
LSTAADVWAVVWDGMASGLDKDYLKPDD

SEQ ID NO: 142 - protein, 28 aa, Artificial Sequence
  Description of Artificial Sequence: Synthetic peptide
  N-term acetylated
LSTAADVWAVVWDGMASGLDKDYLKPDD

SEQ ID NO: 143 - protein, 28 aa, Artificial Sequence
  Description of Artificial Sequence: Synthetic peptide
LSWAADVWAVVWDGMASGLDKDYLKPDD

SEQ ID NO: 144 - protein, 28 aa, Artificial Sequence
  Description of Artificial Sequence: Synthetic peptide
  N-term acetylated
LSWAADVWAVVWDGMASGLDKDYLKPDD

SEQ ID NO: 145 - protein, 28 aa, Artificial Sequence
  Description of Artificial Sequence: Synthetic peptide
LSTAADMQGVVTDTMASGLDKDYLKPDD

SEQ ID NO: 146 - protein, 28 aa, Artificial Sequence
  Description of Artificial Sequence: Synthetic peptide
  N-term acetylated
LSTAADMQGVVTDTMASGLDKDYLKPDD

SEQ ID NO: 147 - protein, 28 aa, Artificial Sequence
  Description of Artificial Sequence: Synthetic peptide
LSWAADMQGVVTDTMASGLDKDYLKPDD

SEQ ID NO: 148 - protein, 28 aa, Artificial Sequence
  Description of Artificial Sequence: Synthetic peptide
  N-term acetylated
LSWAADMQGVVTDTMASGLDKDYLKPDD

SEQ ID NO: 149 - protein, 28 aa, Artificial Sequence
  Description of Artificial Sequence: Synthetic peptide
LSTAADLQGVVTDTMASGLDKDYLKPDD

SEQ ID NO: 150 - protein, 28 aa, Artificial Sequence
  Description of Artificial Sequence: Synthetic peptide
  N-term acetylated
LSTAADLQGVVTDTMASGLDKDYLKPDD

SEQ ID NO: 151 - protein, 28 aa, Artificial Sequence
  Description of Artificial Sequence: Synthetic peptide
LSWAADLQGVVTDTMASGLDKDYLKPDD

SEQ ID NO: 152 - protein, 28 aa, Artificial Sequence
  Description of Artificial Sequence: Synthetic peptide
  N-term acetylated
LSWAADLQGVVTDTMASGLDKDYLKPDD

SEQ ID NO: 153 - protein, 28 aa, Artificial Sequence
  Description of Artificial Sequence: Synthetic peptide
LSTAADVQGVVTDTMASGLDKDYLKPDD

SEQ ID NO: 154 - protein, 28 aa, Artificial Sequence
  Description of Artificial Sequence: Synthetic peptide
  N-term acetylated
LSTAADVQGVVTDTMASGLDKDYLKPDD

SEQ ID NO: 155 - protein, 28 aa, Artificial Sequence
  Description of Artificial Sequence: Synthetic peptide
LSWAADVQGVVTDTMASGLDKDYLKPDD

SEQ ID NO: 156 - protein, 28 aa, Artificial Sequence
  Description of Artificial Sequence: Synthetic peptide
  N-term acetylated
LSWAADVQGVVTDTMASGLDKDYLKPDD

SEQ ID NO: 157 - protein, 28 aa, Artificial Sequence
  Description of Artificial Sequence: Synthetic peptide
LSTAADMWGVVTDTMASGLDKDYLKPDD

SEQ ID NO: 158 - protein, 28 aa, Artificial Sequence
  Description of Artificial Sequence: Synthetic peptide
  N-term acetylated
LSTAADMWGVVTDTMASGLDKDYLKPDD

SEQ ID NO: 159 - protein, 28 aa, Artificial Sequence
  Description of Artificial Sequence: Synthetic peptide
LSWAADMWGVVTDTMASGLDKDYLKPDD

SEQ ID NO: 160 - protein, 28 aa, Artificial Sequence
  Description of Artificial Sequence: Synthetic peptide
  N-term acetylated
LSWAADMWGVVTDTMASGLDKDYLKPDD

SEQ ID NO: 161 - protein, 28 aa, Artificial Sequence
  Description of Artificial Sequence: Synthetic peptide
LSTAADLWGVVTDTMASGLDKDYLKPDD

SEQ ID NO: 162 - protein, 28 aa, Artificial Sequence
  Description of Artificial Sequence: Synthetic peptide
  N-term acetylated
LSTAADLWGVVTDTMASGLDKDYLKPDD

SEQ ID NO: 163 - protein, 28 aa, Artificial Sequence
  Description of Artificial Sequence: Synthetic peptide
LSWAADLWGVVTDTMASGLDKDYLKPDD

SEQ ID NO: 164 - protein, 28 aa, Artificial Sequence
  Description of Artificial Sequence: Synthetic peptide
  N-term acetylated
LSWAADLWGVVTDTMASGLDKDYLKPDD

SEQ ID NO: 165 - protein, 28 aa, Artificial Sequence
  Description of Artificial Sequence: Synthetic peptide
LSTAADVWGVVTDTMASGLDKDYLKPDD

SEQ ID NO: 166 - protein, 28 aa, Artificial Sequence
  Description of Artificial Sequence: Synthetic peptide
  N-term acetylated
LSTAADVWGVVTDTMASGLDKDYLKPDD

SEQ ID NO: 167 - protein, 28 aa, Artificial Sequence
  Description of Artificial Sequence: Synthetic peptide
LSWAADVWGVVTDTMASGLDKDYLKPDD

SEQ ID NO: 168 - protein, 28 aa, Artificial Sequence
  Description of Artificial Sequence: Synthetic peptide
  N-term acetylated
LSWAADVWGVVTDTMASGLDKDYLKPDD

SEQ ID NO: 169 - protein, 28 aa, Artificial Sequence
  Description of Artificial Sequence: Synthetic peptide
LSTAADMQAVVTDTMASGLDKDYLKPDD

SEQ ID NO: 170 - protein, 28 aa, Artificial Sequence
  Description of Artificial Sequence: Synthetic peptide
  N-term acetylated
LSTAADMQAVVTDTMASGLDKDYLKPDD

SEQ ID NO: 171 - protein, 28 aa, Artificial Sequence
  Description of Artificial Sequence: Synthetic peptide
LSWAADMQAVVTDTMASGLDKDYLKPDD

SEQ ID NO: 172 - protein, 28 aa, Artificial Sequence
  Description of Artificial Sequence: Synthetic peptide
  N-term acetylated
LSWAADMQAVVTDTMASGLDKDYLKPDD

SEQ ID NO: 173 - protein, 28 aa, Artificial Sequence
  Description of Artificial Sequence: Synthetic peptide
LSTAADLQAVVTDTMASGLDKDYLKPDD

SEQ ID NO: 174 - protein, 28 aa, Artificial Sequence
  Description of Artificial Sequence: Synthetic peptide
  N-term acetylated
LSTAADLQAVVTDTMASGLDKDYLKPDD

SEQ ID NO: 175 - protein, 28 aa, Artificial Sequence
  Description of Artificial Sequence: Synthetic peptide
LSWAADLQAVVTDTMASGLDKDYLKPDD

SEQ ID NO: 176 - protein, 28 aa, Artificial Sequence
  Description of Artificial Sequence: Synthetic peptide
  N-term acetylated
LSWAADLQAVVTDTMASGLDKDYLKPDD

SEQ ID NO: 177 - protein, 28 aa, Artificial Sequence
  Description of Artificial Sequence: Synthetic peptide
LSTAADVQAVVTDTMASGLDKDYLKPDD

SEQ ID NO: 178 - protein, 28 aa, Artificial Sequence
  Description of Artificial Sequence: Synthetic peptide
  N-term acetylated
LSTAADVQAVVTDTMASGLDKDYLKPDD

SEQ ID NO: 179 - protein, 28 aa, Artificial Sequence
  Description of Artificial Sequence: Synthetic peptide
LSWAADVQAVVTDTMASGLDKDYLKPDD

SEQ ID NO: 180 - protein, 28 aa, Artificial Sequence
  Description of Artificial Sequence: Synthetic peptide
  N-term acetylated
LSWAADVQAVVTDTMASGLDKDYLKPDD

SEQ ID NO: 181 - protein, 28 aa, Artificial Sequence
  Description of Artificial Sequence: Synthetic peptide
LSTAADMWAVVTDTMASGLDKDYLKPDD

SEQ ID NO: 182 - protein, 28 aa, Artificial Sequence
  Description of Artificial Sequence: Synthetic peptide
  N-term acetylated
LSTAADMWAVVTDTMASGLDKDYLKPDD

SEQ ID NO: 183 - protein, 28 aa, Artificial Sequence
  Description of Artificial Sequence: Synthetic peptide
LSWAADMWAVVTDTMASGLDKDYLKPDD

SEQ ID NO: 184 - protein, 28 aa, Artificial Sequence
  Description of Artificial Sequence: Synthetic peptide
  N-term acetylated
LSWAADMWAVVTDTMASGLDKDYLKPDD

SEQ ID NO: 185 - protein, 28 aa, Artificial Sequence
  Description of Artificial Sequence: Synthetic peptide
LSTAADLWAVVTDTMASGLDKDYLKPDD

SEQ ID NO: 186 - protein, 28 aa, Artificial Sequence
  Description of Artificial Sequence: Synthetic peptide
  N-term acetylated
LSTAADLWAVVTDTMASGLDKDYLKPDD

SEQ ID NO: 187 - protein, 28 aa, Artificial Sequence
  Description of Artificial Sequence: Synthetic peptide
LSWAADLWAVVTDTMASGLDKDYLKPDD

SEQ ID NO: 188 - protein, 28 aa, Artificial Sequence
  Description of Artificial Sequence: Synthetic peptide
  N-term acetylated
LSWAADLWAVVTDTMASGLDKDYLKPDD

SEQ ID NO: 189 - protein, 28 aa, Artificial Sequence
  Description of Artificial Sequence: Synthetic peptide
LSTAADVWAVVTDTMASGLDKDYLKPDD

SEQ ID NO: 190 - protein, 28 aa, Artificial Sequence
  Description of Artificial Sequence: Synthetic peptide
  N-term acetylated
LSTAADVWAVVTDTMASGLDKDYLKPDD

SEQ ID NO: 191 - protein, 28 aa, Artificial Sequence
  Description of Artificial Sequence: Synthetic peptide
LSWAADVWAVVTDTMASGLDKDYLKPDD

SEQ ID NO: 192 - protein, 28 aa, Artificial Sequence
  Description of Artificial Sequence: Synthetic peptide
  N-term acetylated
LSWAADVWAVVTDTMASGLDKDYLKPDD

SEQ ID NO: 193 - protein, 28 aa, Artificial Sequence
  Description of Artificial Sequence: Synthetic peptide
LSTAADMQGVVWDTMASGLDKDYLKPDD

SEQ ID NO: 194 - protein, 28 aa, Artificial Sequence
  Description of Artificial Sequence: Synthetic peptide
  N-term acetylated
LSTAADMQGVVWDTMASGLDKDYLKPDD

SEQ ID NO: 195 - protein, 28 aa, Artificial Sequence
  Description of Artificial Sequence: Synthetic peptide
LSWAADMQGVVWDTMASGLDKDYLKPDD

SEQ ID NO: 196 - protein, 28 aa, Artificial Sequence
  Description of Artificial Sequence: Synthetic peptide
  N-term acetylated
LSWAADMQGVVWDTMASGLDKDYLKPDD

SEQ ID NO: 197 - protein, 28 aa, Artificial Sequence
  Description of Artificial Sequence: Synthetic peptide
LSTAADLQGVVWDTMASGLDKDYLKPDD

SEQ ID NO: 198 - protein, 28 aa, Artificial Sequence
  Description of Artificial Sequence: Synthetic peptide
  N-term acetylated
LSTAADLQGVVWDTMASGLDKDYLKPDD

SEQ ID NO: 199 - protein, 28 aa, Artificial Sequence
  Description of Artificial Sequence: Synthetic peptide
LSWAADLQGVVWDTMASGLDKDYLKPDD

SEQ ID NO: 200 - protein, 28 aa, Artificial Sequence
  Description of Artificial Sequence: Synthetic peptide
  N-term acetylated
LSWAADLQGVVWDTMASGLDKDYLKPDD

SEQ ID NO: 201 - protein, 28 aa, Artificial Sequence
  Description of Artificial Sequence: Synthetic peptide
LSTAADVQGVVWDTMASGLDKDYLKPDD

SEQ ID NO: 202 - protein, 28 aa, Artificial Sequence
  Description of Artificial Sequence: Synthetic peptide
  N-term acetylated
LSTAADVQGVVWDTMASGLDKDYLKPDD

SEQ ID NO: 203 - protein, 28 aa, Artificial Sequence
  Description of Artificial Sequence: Synthetic peptide
LSWAADVQGVVWDTMASGLDKDYLKPDD

SEQ ID NO: 204 - protein, 28 aa, Artificial Sequence
  Description of Artificial Sequence: Synthetic peptide
  N-term acetylated
LSWAADVQGVVWDTMASGLDKDYLKPDD

SEQ ID NO: 205 - protein, 28 aa, Artificial Sequence
  Description of Artificial Sequence: Synthetic peptide
LSTAADMWGVVWDTMASGLDKDYLKPDD

SEQ ID NO: 206 - protein, 28 aa, Artificial Sequence
  Description of Artificial Sequence: Synthetic peptide
  N-term acetylated
LSTAADMWGVVWDTMASGLDKDYLKPDD

SEQ ID NO: 207 - protein, 28 aa, Artificial Sequence
  Description of Artificial Sequence: Synthetic peptide
LSWAADMWGVVWDTMASGLDKDYLKPDD

SEQ ID NO: 208 - protein, 28 aa, Artificial Sequence
  Description of Artificial Sequence: Synthetic peptide
  N-term acetylated
LSWAADMWGVVWDTMASGLDKDYLKPDD

SEQ ID NO: 209 - protein, 28 aa, Artificial Sequence
  Description of Artificial Sequence: Synthetic peptide
LSTAADLWGVVWDTMASGLDKDYLKPDD

SEQ ID NO: 210 - protein, 28 aa, Artificial Sequence
  Description of Artificial Sequence: Synthetic peptide
  N-term acetylated
LSTAADLWGVVWDTMASGLDKDYLKPDD

SEQ ID NO: 211 - protein, 28 aa, Artificial Sequence
  Description of Artificial Sequence: Synthetic peptide
LSWAADLWGVVWDTMASGLDKDYLKPDD

SEQ ID NO: 212 - protein, 28 aa, Artificial Sequence
  Description of Artificial Sequence: Synthetic peptide
  N-term acetylated
LSWAADLWGVVWDTMASGLDKDYLKPDD

SEQ ID NO: 213 - protein, 28 aa, Artificial Sequence
  Description of Artificial Sequence: Synthetic peptide
LSTAADVWGVVWDTMASGLDKDYLKPDD

SEQ ID NO: 214 - protein, 28 aa, Artificial Sequence
  Description of Artificial Sequence: Synthetic peptide
  N-term acetylated
LSTAADVWGVVWDTMASGLDKDYLKPDD

SEQ ID NO: 215 - protein, 28 aa, Artificial Sequence
  Description of Artificial Sequence: Synthetic peptide
LSWAADVWGVVWDTMASGLDKDYLKPDD

SEQ ID NO: 216 - protein, 28 aa, Artificial Sequence
  Description of Artificial Sequence: Synthetic peptide
  N-term acetylated
LSWAADVWGVVWDTMASGLDKDYLKPDD

SEQ ID NO: 217 - protein, 28 aa, Artificial Sequence
  Description of Artificial Sequence: Synthetic peptide
LSTAADMQAVVWDTMASGLDKDYLKPDD

SEQ ID NO: 218 - protein, 28 aa, Artificial Sequence
  Description of Artificial Sequence: Synthetic peptide
  N-term acetylated
LSTAADMQAVVWDTMASGLDKDYLKPDD

SEQ ID NO: 219 - protein, 28 aa, Artificial Sequence
  Description of Artificial Sequence: Synthetic peptide
LSWAADMQAVVWDTMASGLDKDYLKPDD

SEQ ID NO: 220 - protein, 28 aa, Artificial Sequence
  Description of Artificial Sequence: Synthetic peptide
  N-term acetylated
LSWAADMQAVVWDTMASGLDKDYLKPDD

SEQ ID NO: 221 - protein, 28 aa, Artificial Sequence
  Description of Artificial Sequence: Synthetic peptide
LSTAADLQAVVWDTMASGLDKDYLKPDD

SEQ ID NO: 222 - protein, 28 aa, Artificial Sequence
  Description of Artificial Sequence: Synthetic peptide
  N-term acetylated
LSTAADLQAVVWDTMASGLDKDYLKPDD

SEQ ID NO: 223 - protein, 28 aa, Artificial Sequence
  Description of Artificial Sequence: Synthetic peptide
LSWAADLQAVVWDTMASGLDKDYLKPDD

SEQ ID NO: 224 - protein, 28 aa, Artificial Sequence
  Description of Artificial Sequence: Synthetic peptide
  N-term acetylated
LSWAADLQAVVWDTMASGLDKDYLKPDD

SEQ ID NO: 225 - protein, 28 aa, Artificial Sequence
  Description of Artificial Sequence: Synthetic peptide
LSTAADVQAVVWDTMASGLDKDYLKPDD

SEQ ID NO: 226 - protein, 28 aa, Artificial Sequence
  Description of Artificial Sequence: Synthetic peptide
  N-term acetylated
LSTAADVQAVVWDTMASGLDKDYLKPDD

SEQ ID NO: 227 - protein, 28 aa, Artificial Sequence
  Description of Artificial Sequence: Synthetic peptide
LSWAADVQAVVWDTMASGLDKDYLKPDD

SEQ ID NO: 228 - protein, 28 aa, Artificial Sequence
  Description of Artificial Sequence: Synthetic peptide
  N-term acetylated
LSWAADVQAVVWDTMASGLDKDYLKPDD

SEQ ID NO: 229 - protein, 28 aa, Artificial Sequence
  Description of Artificial Sequence: Synthetic peptide
LSTAADMWAVVWDTMASGLDKDYLKPDD

SEQ ID NO: 230 - protein, 28 aa, Artificial Sequence
  Description of Artificial Sequence: Synthetic peptide
  N-term acetylated
LSTAADMWAVVWDTMASGLDKDYLKPDD

SEQ ID NO: 231 - protein, 28 aa, Artificial Sequence
  Description of Artificial Sequence: Synthetic peptide
LSWAADMWAVVWDTMASGLDKDYLKPDD

SEQ ID NO: 232 - protein, 28 aa, Artificial Sequence
  Description of Artificial Sequence: Synthetic peptide
  N-term acetylated
LSWAADMWAVVWDTMASGLDKDYLKPDD

SEQ ID NO: 233 - protein, 28 aa, Artificial Sequence
  Description of Artificial Sequence: Synthetic peptide
LSTAADLWAVVWDTMASGLDKDYLKPDD

SEQ ID NO: 234 - protein, 28 aa, Artificial Sequence
  Description of Artificial Sequence: Synthetic peptide
  N-term acetylated
LSTAADLWAVVWDTMASGLDKDYLKPDD

SEQ ID NO: 235 - protein, 28 aa, Artificial Sequence
  Description of Artificial Sequence: Synthetic peptide
LSWAADLWAVVWDTMASGLDKDYLKPDD

SEQ ID NO: 236 - protein, 28 aa, Artificial Sequence
  Description of Artificial Sequence: Synthetic peptide
  N-term acetylated
LSWAADLWAVVWDTMASGLDKDYLKPDD

SEQ ID NO: 237 - protein, 28 aa, Artificial Sequence
  Description of Artificial Sequence: Synthetic peptide
LSTAADVWAVVWDTMASGLDKDYLKPDD

SEQ ID NO: 238 - protein, 28 aa, Artificial Sequence
  Description of Artificial Sequence: Synthetic peptide
  N-term acetylated
LSTAADVWAVVWDTMASGLDKDYLKPDD

SEQ ID NO: 239 - protein, 28 aa, Artificial Sequence
  Description of Artificial Sequence: Synthetic peptide
LSWAADVWAVVWDTMASGLDKDYLKPDD

SEQ ID NO: 240 - protein, 28 aa, Artificial Sequence
  Description of Artificial Sequence: Synthetic peptide
  N-term acetylated
LSWAADVWAVVWDTMASGLDKDYLKPDD

SEQ ID NO: 241 - protein, 28 aa, Artificial Sequence
  Description of Artificial Sequence: Synthetic peptide
LSTAADMQGVVTDWMASGLDKDYLKPDD

SEQ ID NO: 242 - protein, 28 aa, Artificial Sequence
  Description of Artificial Sequence: Synthetic peptide
  N-term acetylated
LSTAADMQGVVTDWMASGLDKDYLKPDD

SEQ ID NO: 243 - protein, 28 aa, Artificial Sequence
  Description of Artificial Sequence: Synthetic peptide
LSWAADMQGVVTDWMASGLDKDYLKPDD

SEQ ID NO: 244 - protein, 28 aa, Artificial Sequence
  Description of Artificial Sequence: Synthetic peptide
  N-term acetylated
LSWAADMQGVVTDWMASGLDKDYLKPDD

SEQ ID NO: 245 - protein, 28 aa, Artificial Sequence
  Description of Artificial Sequence: Synthetic peptide
LSTAADLQGVVTDWMASGLDKDYLKPDD

SEQ ID NO: 246 - protein, 28 aa, Artificial Sequence
  Description of Artificial Sequence: Synthetic peptide
  N-term acetylated
LSTAADLQGVVTDWMASGLDKDYLKPDD

SEQ ID NO: 247 - protein, 28 aa, Artificial Sequence
  Description of Artificial Sequence: Synthetic peptide
LSWAADLQGVVTDWMASGLDKDYLKPDD

SEQ ID NO: 248 - protein, 28 aa, Artificial Sequence
  Description of Artificial Sequence: Synthetic peptide
  N-term acetylated
LSWAADLQGVVTDWMASGLDKDYLKPDD

SEQ ID NO: 249 - protein, 28 aa, Artificial Sequence
  Description of Artificial Sequence: Synthetic peptide
LSTAADVQGVVTDWMASGLDKDYLKPDD

SEQ ID NO: 250 - protein, 28 aa, Artificial Sequence
  Description of Artificial Sequence: Synthetic peptide
  N-term acetylated
LSTAADVQGVVTDWMASGLDKDYLKPDD

SEQ ID NO: 251 - protein, 28 aa, Artificial Sequence
  Description of Artificial Sequence: Synthetic peptide
LSWAADVQGVVTDWMASGLDKDYLKPDD

SEQ ID NO: 252 - protein, 28 aa, Artificial Sequence
  Description of Artificial Sequence: Synthetic peptide
  N-term acetylated
LSWAADVQGVVTDWMASGLDKDYLKPDD

SEQ ID NO: 253 - protein, 28 aa, Artificial Sequence
  Description of Artificial Sequence: Synthetic peptide
LSTAADMWGVVTDWMASGLDKDYLKPDD

SEQ ID NO: 254 - protein, 28 aa, Artificial Sequence
  Description of Artificial Sequence: Synthetic peptide
  N-term acetylated
LSTAADMWGVVTDWMASGLDKDYLKPDD

SEQ ID NO: 255 - protein, 28 aa, Artificial Sequence
  Description of Artificial Sequence: Synthetic peptide
LSWAADMWGVVTDWMASGLDKDYLKPDD

SEQ ID NO: 256 - protein, 28 aa, Artificial Sequence
  Description of Artificial Sequence: Synthetic peptide
  N-term acetylated
LSWAADMWGVVTDWMASGLDKDYLKPDD

SEQ ID NO: 257 - protein, 28 aa, Artificial Sequence
  Description of Artificial Sequence: Synthetic peptide
LSTAADLWGVVTDWMASGLDKDYLKPDD

SEQ ID NO: 258 - protein, 28 aa, Artificial Sequence
  Description of Artificial Sequence: Synthetic peptide
  N-term acetylated
LSTAADLWGVVTDWMASGLDKDYLKPDD

SEQ ID NO: 259 - protein, 28 aa, Artificial Sequence
  Description of Artificial Sequence: Synthetic peptide
LSWAADLWGVVTDWMASGLDKDYLKPDD

SEQ ID NO: 260 - protein, 28 aa, Artificial Sequence
  Description of Artificial Sequence: Synthetic peptide
  N-term acetylated
LSWAADLWGVVTDWMASGLDKDYLKPDD

SEQ ID NO: 261 - protein, 28 aa, Artificial Sequence
  Description of Artificial Sequence: Synthetic peptide
LSTAADVWGVVTDWMASGLDKDYLKPDD

SEQ ID NO: 262 - protein, 28 aa, Artificial Sequence
  Description of Artificial Sequence: Synthetic peptide
  N-term acetylated
LSTAADVWGVVTDWMASGLDKDYLKPDD

SEQ ID NO: 263 - protein, 28 aa, Artificial Sequence
  Description of Artificial Sequence: Synthetic peptide
LSWAADVWGVVTDWMASGLDKDYLKPDD

SEQ ID NO: 264 - protein, 28 aa, Artificial Sequence
  Description of Artificial Sequence: Synthetic peptide
  N-term acetylated
LSWAADVWGVVTDWMASGLDKDYLKPDD

SEQ ID NO: 265 - protein, 28 aa, Artificial Sequence
  Description of Artificial Sequence: Synthetic peptide
LSTAADMQAVVTDWMASGLDKDYLKPDD

SEQ ID NO: 266 - protein, 28 aa, Artificial Sequence
  Description of Artificial Sequence: Synthetic peptide
  N-term acetylated
LSTAADMQAVVTDWMASGLDKDYLKPDD

SEQ ID NO: 267 - protein, 28 aa, Artificial Sequence
  Description of Artificial Sequence: Synthetic peptide
LSWAADMQAVVTDWMASGLDKDYLKPDD

SEQ ID NO: 268 - protein, 28 aa, Artificial Sequence
  Description of Artificial Sequence: Synthetic peptide
  N-term acetylated
LSWAADMQAVVTDWMASGLDKDYLKPDD

SEQ ID NO: 269 - protein, 28 aa, Artificial Sequence
  Description of Artificial Sequence: Synthetic peptide
LSTAADLQAVVTDWMASGLDKDYLKPDD

SEQ ID NO: 270 - protein, 28 aa, Artificial Sequence
  Description of Artificial Sequence: Synthetic peptide
  N-term acetylated
LSTAADLQAVVTDWMASGLDKDYLKPDD

SEQ ID NO: 271 - protein, 28 aa, Artificial Sequence
  Description of Artificial Sequence: Synthetic peptide
LSWAADLQAVVTDWMASGLDKDYLKPDD

SEQ ID NO: 272 - protein, 28 aa, Artificial Sequence
  Description of Artificial Sequence: Synthetic peptide
  N-term acetylated
LSWAADLQAVVTDWMASGLDKDYLKPDD

SEQ ID NO: 273 - protein, 28 aa, Artificial Sequence
  Description of Artificial Sequence: Synthetic peptide
LSTAADVQAVVTDWMASGLDKDYLKPDD

SEQ ID NO: 274 - protein, 28 aa, Artificial Sequence
  Description of Artificial Sequence: Synthetic peptide
  N-term acetylated
LSTAADVQAVVTDWMASGLDKDYLKPDD

SEQ ID NO: 275 - protein, 28 aa, Artificial Sequence
  Description of Artificial Sequence: Synthetic peptide
LSWAADVQAVVTDWMASGLDKDYLKPDD

SEQ ID NO: 276 - protein, 28 aa, Artificial Sequence
  Description of Artificial Sequence: Synthetic peptide
  N-term acetylated
LSWAADVQAVVTDWMASGLDKDYLKPDD

SEQ ID NO: 277 - protein, 28 aa, Artificial Sequence
  Description of Artificial Sequence: Synthetic peptide
LSTAADMWAVVTDWMASGLDKDYLKPDD

SEQ ID NO: 278 - protein, 28 aa, Artificial Sequence
  Description of Artificial Sequence: Synthetic peptide
  N-term acetylated
LSTAADMWAVVTDWMASGLDKDYLKPDD

SEQ ID NO: 279 - protein, 28 aa, Artificial Sequence
  Description of Artificial Sequence: Synthetic peptide
LSWAADMWAVVTDWMASGLDKDYLKPDD

SEQ ID NO: 280 - protein, 28 aa, Artificial Sequence
  Description of Artificial Sequence: Synthetic peptide
  N-term acetylated
LSWAADMWAVVTDWMASGLDKDYLKPDD

SEQ ID NO: 281 - protein, 28 aa, Artificial Sequence
  Description of Artificial Sequence: Synthetic peptide
LSTAADLWAVVTDWMASGLDKDYLKPDD

SEQ ID NO: 282 - protein, 28 aa, Artificial Sequence
  Description of Artificial Sequence: Synthetic peptide
  N-term acetylated
LSTAADLWAVVTDWMASGLDKDYLKPDD

SEQ ID NO: 283 - protein, 28 aa, Artificial Sequence
  Description of Artificial Sequence: Synthetic peptide
LSWAADLWAVVTDWMASGLDKDYLKPDD

SEQ ID NO: 284 - protein, 28 aa, Artificial Sequence
  Description of Artificial Sequence: Synthetic peptide
  N-term acetylated
LSWAADLWAVVTDWMASGLDKDYLKPDD

SEQ ID NO: 285 - protein, 28 aa, Artificial Sequence
  Description of Artificial Sequence: Synthetic peptide
LSTAADVWAVVTDWMASGLDKDYLKPDD

SEQ ID NO: 286 - protein, 28 aa, Artificial Sequence
  Description of Artificial Sequence: Synthetic peptide
  N-term acetylated
LSTAADVWAVVTDWMASGLDKDYLKPDD

SEQ ID NO: 287 - protein, 28 aa, Artificial Sequence
  Description of Artificial Sequence: Synthetic peptide
LSWAADVWAVVTDWMASGLDKDYLKPDD

SEQ ID NO: 288 - protein, 28 aa, Artificial Sequence
  Description of Artificial Sequence: Synthetic peptide
  N-term acetylated
LSWAADVWAVVTDWMASGLDKDYLKPDD

SEQ ID NO: 289 - protein, 28 aa, Artificial Sequence
  Description of Artificial Sequence: Synthetic peptide
LSTAADMQGVVWDWMASGLDKDYLKPDD

SEQ ID NO: 290 - protein, 28 aa, Artificial Sequence
  Description of Artificial Sequence: Synthetic peptide
  N-term acetylated
LSTAADMQGVVWDWMASGLDKDYLKPDD

SEQ ID NO: 291 - protein, 28 aa, Artificial Sequence
  Description of Artificial Sequence: Synthetic peptide
LSWAADMQGVVWDWMASGLDKDYLKPDD

SEQ ID NO: 292 - protein, 28 aa, Artificial Sequence
  Description of Artificial Sequence: Synthetic peptide
  N-term acetylated
LSWAADMQGVVWDWMASGLDKDYLKPDD

SEQ ID NO: 293 - protein, 28 aa, Artificial Sequence
  Description of Artificial Sequence: Synthetic peptide
LSTAADLQGVVWDWMASGLDKDYLKPDD

SEQ ID NO: 294 - protein, 28 aa, Artificial Sequence
  Description of Artificial Sequence: Synthetic peptide
  N-term acetylated
LSTAADLQGVVWDWMASGLDKDYLKPDD

SEQ ID NO: 295 - protein, 28 aa, Artificial Sequence
  Description of Artificial Sequence: Synthetic peptide
LSWAADLQGVVWDWMASGLDKDYLKPDD

SEQ ID NO: 296 - protein, 28 aa, Artificial Sequence
  Description of Artificial Sequence: Synthetic peptide
  N-term acetylated
LSWAADLQGVVWDWMASGLDKDYLKPDD

SEQ ID NO: 297 - protein, 28 aa, Artificial Sequence
  Description of Artificial Sequence: Synthetic peptide
LSTAADVQGVVWDWMASGLDKDYLKPDD

SEQ ID NO: 298 - protein, 28 aa, Artificial Sequence
  Description of Artificial Sequence: Synthetic peptide
  N-term acetylated
LSTAADVQGVVWDWMASGLDKDYLKPDD

SEQ ID NO: 299 - protein, 28 aa, Artificial Sequence
  Description of Artificial Sequence: Synthetic peptide
LSWAADVQGVVWDWMASGLDKDYLKPDD

SEQ ID NO: 300 - protein, 28 aa, Artificial Sequence
  Description of Artificial Sequence: Synthetic peptide
  N-term acetylated
LSWAADVQGVVWDWMASGLDKDYLKPDD

SEQ ID NO: 301 - protein, 28 aa, Artificial Sequence
  Description of Artificial Sequence: Synthetic peptide
LSTAADMWGVVWDWMASGLDKDYLKPDD

SEQ ID NO: 302 - protein, 28 aa, Artificial Sequence
  Description of Artificial Sequence: Synthetic peptide
  N-term acetylated
LSTAADMWGVVWDWMASGLDKDYLKPDD

SEQ ID NO: 303 - protein, 28 aa, Artificial Sequence
  Description of Artificial Sequence: Synthetic peptide
LSWAADMWGVVWDWMASGLDKDYLKPDD

SEQ ID NO: 304 - protein, 28 aa, Artificial Sequence
  Description of Artificial Sequence: Synthetic peptide
  N-term acetylated
LSWAADMWGVVWDWMASGLDKDYLKPDD

SEQ ID NO: 305 - protein, 28 aa, Artificial Sequence
  Description of Artificial Sequence: Synthetic peptide
LSTAADLWGVVWDWMASGLDKDYLKPDD

SEQ ID NO: 306 - protein, 28 aa, Artificial Sequence
  Description of Artificial Sequence: Synthetic peptide
  N-term acetylated
LSTAADLWGVVWDWMASGLDKDYLKPDD

SEQ ID NO: 307 - protein, 28 aa, Artificial Sequence
  Description of Artificial Sequence: Synthetic peptide
LSWAADLWGVVWDWMASGLDKDYLKPDD

SEQ ID NO: 308 - protein, 28 aa, Artificial Sequence
  Description of Artificial Sequence: Synthetic peptide
  N-term acetylated
LSWAADLWGVVWDWMASGLDKDYLKPDD

SEQ ID NO: 309 - protein, 28 aa, Artificial Sequence
  Description of Artificial Sequence: Synthetic peptide
LSTAADVWGVVWDWMASGLDKDYLKPDD

SEQ ID NO: 310 - protein, 28 aa, Artificial Sequence
  Description of Artificial Sequence: Synthetic peptide
  N-term acetylated
LSTAADVWGVVWDWMASGLDKDYLKPDD

SEQ ID NO: 311 - protein, 28 aa, Artificial Sequence
  Description of Artificial Sequence: Synthetic peptide
LSWAADVWGVVWDWMASGLDKDYLKPDD

SEQ ID NO: 312 - protein, 28 aa, Artificial Sequence
  Description of Artificial Sequence: Synthetic peptide
  N-term acetylated
LSWAADVWGVVWDWMASGLDKDYLKPDD

SEQ ID NO: 313 - protein, 28 aa, Artificial Sequence
  Description of Artificial Sequence: Synthetic peptide
LSTAADMQAVVWDWMASGLDKDYLKPDD

SEQ ID NO: 314 - protein, 28 aa, Artificial Sequence
  Description of Artificial Sequence: Synthetic peptide
  N-term acetylated
LSTAADMQAVVWDWMASGLDKDYLKPDD

SEQ ID NO: 315 - protein, 28 aa, Artificial Sequence
  Description of Artificial Sequence: Synthetic peptide
LSWAADMQAVVWDWMASGLDKDYLKPDD

SEQ ID NO: 316 - protein, 28 aa, Artificial Sequence
  Description of Artificial Sequence: Synthetic peptide
  N-term acetylated
LSWAADMQAVVWDWMASGLDKDYLKPDD

SEQ ID NO: 317 - protein, 28 aa, Artificial Sequence
  Description of Artificial Sequence: Synthetic peptide
LSTAADLQAVVWDWMASGLDKDYLKPDD

SEQ ID NO: 318 - protein, 28 aa, Artificial Sequence
  Description of Artificial Sequence: Synthetic peptide
  N-term acetylated
LSTAADLQAVVWDWMASGLDKDYLKPDD

SEQ ID NO: 319 - protein, 28 aa, Artificial Sequence
  Description of Artificial Sequence: Synthetic peptide
LSWAADLQAVVWDWMASGLDKDYLKPDD

SEQ ID NO: 320 - protein, 28 aa, Artificial Sequence
  Description of Artificial Sequence: Synthetic peptide
  N-term acetylated
LSWAADLQAVVWDWMASGLDKDYLKPDD

SEQ ID NO: 321 - protein, 28 aa, Artificial Sequence
  Description of Artificial Sequence: Synthetic peptide
LSTAADVQAVVWDWMASGLDKDYLKPDD

SEQ ID NO: 322 - protein, 28 aa, Artificial Sequence
  Description of Artificial Sequence: Synthetic peptide
  N-term acetylated
LSTAADVQAVVWDWMASGLDKDYLKPDD

SEQ ID NO: 323 - protein, 28 aa, Artificial Sequence
  Description of Artificial Sequence: Synthetic peptide
LSWAADVQAVVWDWMASGLDKDYLKPDD

SEQ ID NO: 324 - protein, 28 aa, Artificial Sequence
  Description of Artificial Sequence: Synthetic peptide
  N-term acetylated
LSWAADVQAVVWDWMASGLDKDYLKPDD

SEQ ID NO: 325 - protein, 28 aa, Artificial Sequence
  Description of Artificial Sequence: Synthetic peptide
LSTAADMWAVVWDWMASGLDKDYLKPDD

SEQ ID NO: 326 - protein, 28 aa, Artificial Sequence
  Description of Artificial Sequence: Synthetic peptide
  N-term acetylated
LSTAADMWAVVWDWMASGLDKDYLKPDD

SEQ ID NO: 327 - protein, 28 aa, Artificial Sequence
  Description of Artificial Sequence: Synthetic peptide
LSWAADMWAVVWDWMASGLDKDYLKPDD

SEQ ID NO: 328 - protein, 28 aa, Artificial Sequence
  Description of Artificial Sequence: Synthetic peptide
  N-term acetylated
LSWAADMWAVVWDWMASGLDKDYLKPDD

SEQ ID NO: 329 - protein, 28 aa, Artificial Sequence
  Description of Artificial Sequence: Synthetic peptide
LSTAADLWAVVWDWMASGLDKDYLKPDD

SEQ ID NO: 330 - protein, 28 aa, Artificial Sequence
  Description of Artificial Sequence: Synthetic peptide
  N-term acetylated
LSTAADLWAVVWDWMASGLDKDYLKPDD

SEQ ID NO: 331 - protein, 28 aa, Artificial Sequence
  Description of Artificial Sequence: Synthetic peptide
LSWAADLWAVVWDWMASGLDKDYLKPDD

SEQ ID NO: 332 - protein, 28 aa, Artificial Sequence
  Description of Artificial Sequence: Synthetic peptide
  N-term acetylated
LSWAADLWAVVWDWMASGLDKDYLKPDD

SEQ ID NO: 333 - protein, 28 aa, Artificial Sequence
  Description of Artificial Sequence: Synthetic peptide
LSTAADVWAVVWDWMASGLDKDYLKPDD

SEQ ID NO: 334 - protein, 28 aa, Artificial Sequence
  Description of Artificial Sequence: Synthetic peptide
  N-term acetylated
LSTAADVWAVVWDWMASGLDKDYLKPDD

SEQ ID NO: 335 - protein, 28 aa, Artificial Sequence
  Description of Artificial Sequence: Synthetic peptide
LSWAADVWAVVWDWMASGLDKDYLKPDD

SEQ ID NO: 336 - protein, 28 aa, Artificial Sequence
  Description of Artificial Sequence: Synthetic peptide
  N-term acetylated
LSWAADVWAVVWDWMASGLDKDYLKPDD

SEQ ID NO: 337 - protein, 28 aa, Artificial Sequence
  Description of Artificial Sequence: Synthetic peptide
LSTAADMQGVVTDGLASGLDKDYLKPDD

SEQ ID NO: 338 - protein, 28 aa, Artificial Sequence
  Description of Artificial Sequence: Synthetic peptide
  N-term acetylated
LSTAADMQGVVTDGLASGLDKDYLKPDD

SEQ ID NO: 339 - protein, 28 aa, Artificial Sequence
  Description of Artificial Sequence: Synthetic peptide
LSWAADMQGVVTDGLASGLDKDYLKPDD

SEQ ID NO: 340 - protein, 28 aa, Artificial Sequence
  Description of Artificial Sequence: Synthetic peptide
  N-term acetylated
LSWAADMQGVVTDGLASGLDKDYLKPDD

SEQ ID NO: 341 - protein, 28 aa, Artificial Sequence
  Description of Artificial Sequence: Synthetic peptide
LSTAADLQGVVTDGLASGLDKDYLKPDD

SEQ ID NO: 342 - protein, 28 aa, Artificial Sequence
  Description of Artificial Sequence: Synthetic peptide
  N-term acetylated
LSTAADLQGVVTDGLASGLDKDYLKPDD

SEQ ID NO: 343 - protein, 28 aa, Artificial Sequence
  Description of Artificial Sequence: Synthetic peptide
LSWAADLQGVVTDGLASGLDKDYLKPDD

SEQ ID NO: 344 - protein, 28 aa, Artificial Sequence
  Description of Artificial Sequence: Synthetic peptide
  N-term acetylated
LSWAADLQGVVTDGLASGLDKDYLKPDD

SEQ ID NO: 345 - protein, 28 aa, Artificial Sequence
  Description of Artificial Sequence: Synthetic peptide
LSTAADVQGVVTDGLASGLDKDYLKPDD

SEQ ID NO: 346 - protein, 28 aa, Artificial Sequence
  Description of Artificial Sequence: Synthetic peptide
  N-term acetylated
LSTAADVQGVVTDGLASGLDKDYLKPDD

SEQ ID NO: 347 - protein, 28 aa, Artificial Sequence
  Description of Artificial Sequence: Synthetic peptide
LSWAADVQGVVTDGLASGLDKDYLKPDD

SEQ ID NO: 348 - protein, 28 aa, Artificial Sequence
  Description of Artificial Sequence: Synthetic peptide
  N-term acetylated
LSWAADVQGVVTDGLASGLDKDYLKPDD

SEQ ID NO: 349 - protein, 28 aa, Artificial Sequence
  Description of Artificial Sequence: Synthetic peptide
LSTAADMWGVVTDGLASGLDKDYLKPDD

SEQ ID NO: 350 - protein, 28 aa, Artificial Sequence
  Description of Artificial Sequence: Synthetic peptide
  N-term acetylated
LSTAADMWGVVTDGLASGLDKDYLKPDD

SEQ ID NO: 351 - protein, 28 aa, Artificial Sequence
  Description of Artificial Sequence: Synthetic peptide
LSWAADMWGVVTDGLASGLDKDYLKPDD

SEQ ID NO: 352 - protein, 28 aa, Artificial Sequence
  Description of Artificial Sequence: Synthetic peptide
  N-term acetylated
LSWAADMWGVVTDGLASGLDKDYLKPDD

SEQ ID NO: 353 - protein, 28 aa, Artificial Sequence
  Description of Artificial Sequence: Synthetic peptide
LSTAADLWGVVTDGLASGLDKDYLKPDD

SEQ ID NO: 354 - protein, 28 aa, Artificial Sequence
  Description of Artificial Sequence: Synthetic peptide
  N-term acetylated
LSTAADLWGVVTDGLASGLDKDYLKPDD

SEQ ID NO: 355 - protein, 28 aa, Artificial Sequence
  Description of Artificial Sequence: Synthetic peptide
LSWAADLWGVVTDGLASGLDKDYLKPDD

SEQ ID NO: 356 - protein, 28 aa, Artificial Sequence
  Description of Artificial Sequence: Synthetic peptide
  N-term acetylated
LSWAADLWGVVTDGLASGLDKDYLKPDD

SEQ ID NO: 357 - protein, 28 aa, Artificial Sequence
  Description of Artificial Sequence: Synthetic peptide
LSTAADVWGVVTDGLASGLDKDYLKPDD

SEQ ID NO: 358 - protein, 28 aa, Artificial Sequence
  Description of Artificial Sequence: Synthetic peptide
  N-term acetylated
LSTAADVWGVVTDGLASGLDKDYLKPDD

SEQ ID NO: 359 - protein, 28 aa, Artificial Sequence
  Description of Artificial Sequence: Synthetic peptide
LSWAADVWGVVTDGLASGLDKDYLKPDD

SEQ ID NO: 360 - protein, 28 aa, Artificial Sequence
  Description of Artificial Sequence: Synthetic peptide
  N-term acetylated
LSWAADVWGVVTDGLASGLDKDYLKPDD

SEQ ID NO: 361 - protein, 28 aa, Artificial Sequence
  Description of Artificial Sequence: Synthetic peptide
LSTAADMQAVVTDGLASGLDKDYLKPDD

SEQ ID NO: 362 - protein, 28 aa, Artificial Sequence
  Description of Artificial Sequence: Synthetic peptide
  N-term acetylated
LSTAADMQAVVTDGLASGLDKDYLKPDD

SEQ ID NO: 363 - protein, 28 aa, Artificial Sequence
  Description of Artificial Sequence: Synthetic peptide
LSWAADMQAVVTDGLASGLDKDYLKPDD

SEQ ID NO: 364 - protein, 28 aa, Artificial Sequence
  Description of Artificial Sequence: Synthetic peptide
  N-term acetylated
LSWAADMQAVVTDGLASGLDKDYLKPDD

SEQ ID NO: 365 - protein, 28 aa, Artificial Sequence
  Description of Artificial Sequence: Synthetic peptide
LSTAADLQAVVTDGLASGLDKDYLKPDD

SEQ ID NO: 366 - protein, 28 aa, Artificial Sequence
  Description of Artificial Sequence: Synthetic peptide
  N-term acetylated
LSTAADLQAVVTDGLASGLDKDYLKPDD

SEQ ID NO: 367 - protein, 28 aa, Artificial Sequence
  Description of Artificial Sequence: Synthetic peptide
LSWAADLQAVVTDGLASGLDKDYLKPDD

SEQ ID NO: 368 - protein, 28 aa, Artificial Sequence
  Description of Artificial Sequence: Synthetic peptide
  N-term acetylated
LSWAADLQAVVTDGLASGLDKDYLKPDD

SEQ ID NO: 369 - protein, 28 aa, Artificial Sequence
  Description of Artificial Sequence: Synthetic peptide
LSTAADVQAVVTDGLASGLDKDYLKPDD

SEQ ID NO: 370 - protein, 28 aa, Artificial Sequence
  Description of Artificial Sequence: Synthetic peptide
  N-term acetylated
LSTAADVQAVVTDGLASGLDKDYLKPDD

SEQ ID NO: 371 - protein, 28 aa, Artificial Sequence
  Description of Artificial Sequence: Synthetic peptide
LSWAADVQAVVTDGLASGLDKDYLKPDD

SEQ ID NO: 372 - protein, 28 aa, Artificial Sequence
  Description of Artificial Sequence: Synthetic peptide
  N-term acetylated
LSWAADVQAVVTDGLASGLDKDYLKPDD

SEQ ID NO: 373 - protein, 28 aa, Artificial Sequence
  Description of Artificial Sequence: Synthetic peptide
LSTAADMWAVVTDGLASGLDKDYLKPDD

SEQ ID NO: 374 - protein, 28 aa, Artificial Sequence
  Description of Artificial Sequence: Synthetic peptide
  N-term acetylated
LSTAADMWAVVTDGLASGLDKDYLKPDD

SEQ ID NO: 375 - protein, 28 aa, Artificial Sequence
  Description of Artificial Sequence: Synthetic peptide
LSWAADMWAVVTDGLASGLDKDYLKPDD

SEQ ID NO: 376 - protein, 28 aa, Artificial Sequence
  Description of Artificial Sequence: Synthetic peptide
  N-term acetylated
LSWAADMWAVVTDGLASGLDKDYLKPDD

SEQ ID NO: 377 - protein, 28 aa, Artificial Sequence
  Description of Artificial Sequence: Synthetic peptide
LSTAADLWAVVTDGLASGLDKDYLKPDD

SEQ ID NO: 378 - protein, 28 aa, Artificial Sequence
  Description of Artificial Sequence: Synthetic peptide
  N-term acetylated
LSTAADLWAVVTDGLASGLDKDYLKPDD

SEQ ID NO: 379 - protein, 28 aa, Artificial Sequence
  Description of Artificial Sequence: Synthetic peptide
LSWAADLWAVVTDGLASGLDKDYLKPDD

SEQ ID NO: 380 - protein, 28 aa, Artificial Sequence
  Description of Artificial Sequence: Synthetic peptide
  N-term acetylated
LSWAADLWAVVTDGLASGLDKDYLKPDD

SEQ ID NO: 381 - protein, 28 aa, Artificial Sequence
  Description of Artificial Sequence: Synthetic peptide
LSTAADVWAVVTDGLASGLDKDYLKPDD

SEQ ID NO: 382 - protein, 28 aa, Artificial Sequence
  Description of Artificial Sequence: Synthetic peptide
  N-term acetylated
LSTAADVWAVVTDGLASGLDKDYLKPDD

SEQ ID NO: 383 - protein, 28 aa, Artificial Sequence
  Description of Artificial Sequence: Synthetic peptide
LSWAADVWAVVTDGLASGLDKDYLKPDD

SEQ ID NO: 384 - protein, 28 aa, Artificial Sequence
  Description of Artificial Sequence: Synthetic peptide
  N-term acetylated
LSWAADVWAVVTDGLASGLDKDYLKPDD

SEQ ID NO: 385 - protein, 28 aa, Artificial Sequence
  Description of Artificial Sequence: Synthetic peptide
LSTAADMQGVVWDGLASGLDKDYLKPDD

SEQ ID NO: 386 - protein, 28 aa, Artificial Sequence
  Description of Artificial Sequence: Synthetic peptide
  N-term acetylated
LSTAADMQGVVWDGLASGLDKDYLKPDD

SEQ ID NO: 387 - protein, 28 aa, Artificial Sequence
  Description of Artificial Sequence: Synthetic peptide
LSWAADMQGVVWDGLASGLDKDYLKPDD

SEQ ID NO: 388 - protein, 28 aa, Artificial Sequence
  Description of Artificial Sequence: Synthetic peptide
  N-term acetylated
LSWAADMQGVVWDGLASGLDKDYLKPDD

SEQ ID NO: 389 - protein, 28 aa, Artificial Sequence
  Description of Artificial Sequence: Synthetic peptide
LSTAADLQGVVWDGLASGLDKDYLKPDD

SEQ ID NO: 390 - protein, 28 aa, Artificial Sequence
  Description of Artificial Sequence: Synthetic peptide
  N-term acetylated
LSTAADLQGVVWDGLASGLDKDYLKPDD

SEQ ID NO: 391 - protein, 28 aa, Artificial Sequence
  Description of Artificial Sequence: Synthetic peptide
LSWAADLQGVVWDGLASGLDKDYLKPDD

SEQ ID NO: 392 - protein, 28 aa, Artificial Sequence
  Description of Artificial Sequence: Synthetic peptide
  N-term acetylated
LSWAADLQGVVWDGLASGLDKDYLKPDD

SEQ ID NO: 393 - protein, 28 aa, Artificial Sequence
  Description of Artificial Sequence: Synthetic peptide
LSTAADVQGVVWDGLASGLDKDYLKPDD

SEQ ID NO: 394 - protein, 28 aa, Artificial Sequence
  Description of Artificial Sequence: Synthetic peptide
  N-term acetylated
LSTAADVQGVVWDGLASGLDKDYLKPDD

SEQ ID NO: 395 - protein, 28 aa, Artificial Sequence
  Description of Artificial Sequence: Synthetic peptide
LSWAADVQGVVWDGLASGLDKDYLKPDD

SEQ ID NO: 396 - protein, 28 aa, Artificial Sequence
  Description of Artificial Sequence: Synthetic peptide
  N-term acetylated
LSWAADVQGVVWDGLASGLDKDYLKPDD

SEQ ID NO: 397 - protein, 28 aa, Artificial Sequence
  Description of Artificial Sequence: Synthetic peptide
LSTAADMWGVVWDGLASGLDKDYLKPDD

SEQ ID NO: 398 - protein, 28 aa, Artificial Sequence
  Description of Artificial Sequence: Synthetic peptide
  N-term acetylated
LSTAADMWGVVWDGLASGLDKDYLKPDD

SEQ ID NO: 399 - protein, 28 aa, Artificial Sequence
  Description of Artificial Sequence: Synthetic peptide
LSWAADMWGVVWDGLASGLDKDYLKPDD

SEQ ID NO: 400 - protein, 28 aa, Artificial Sequence
  Description of Artificial Sequence: Synthetic peptide
  N-term acetylated
LSWAADMWGVVWDGLASGLDKDYLKPDD

SEQ ID NO: 401 - protein, 28 aa, Artificial Sequence
  Description of Artificial Sequence: Synthetic peptide
LSTAADLWGVVWDGLASGLDKDYLKPDD

SEQ ID NO: 402 - protein, 28 aa, Artificial Sequence
  Description of Artificial Sequence: Synthetic peptide
  N-term acetylated
LSTAADLWGVVWDGLASGLDKDYLKPDD

SEQ ID NO: 403 - protein, 28 aa, Artificial Sequence
  Description of Artificial Sequence: Synthetic peptide
LSWAADLWGVVWDGLASGLDKDYLKPDD

SEQ ID NO: 404 - protein, 28 aa, Artificial Sequence
  Description of Artificial Sequence: Synthetic peptide
  N-term acetylated
LSWAADLWGVVWDGLASGLDKDYLKPDD

SEQ ID NO: 405 - protein, 28 aa, Artificial Sequence
  Description of Artificial Sequence: Synthetic peptide
LSTAADVWGVVWDGLASGLDKDYLKPDD

SEQ ID NO: 406 - protein, 28 aa, Artificial Sequence
  Description of Artificial Sequence: Synthetic peptide
  N-term acetylated
LSTAADVWGVVWDGLASGLDKDYLKPDD

SEQ ID NO: 407 - protein, 28 aa, Artificial Sequence
  Description of Artificial Sequence: Synthetic peptide
LSWAADVWGVVWDGLASGLDKDYLKPDD

SEQ ID NO: 408 - protein, 28 aa, Artificial Sequence
  Description of Artificial Sequence: Synthetic peptide
  N-term acetylated
LSWAADVWGVVWDGLASGLDKDYLKPDD

SEQ ID NO: 409 - protein, 28 aa, Artificial Sequence
  Description of Artificial Sequence: Synthetic peptide
LSTAADMQAVVWDGLASGLDKDYLKPDD

SEQ ID NO: 410 - protein, 28 aa, Artificial Sequence
  Description of Artificial Sequence: Synthetic peptide
  N-term acetylated
LSTAADMQAVVWDGLASGLDKDYLKPDD

SEQ ID NO: 411 - protein, 28 aa, Artificial Sequence
  Description of Artificial Sequence: Synthetic peptide
LSWAADMQAVVWDGLASGLDKDYLKPDD

SEQ ID NO: 412 - protein, 28 aa, Artificial Sequence
  Description of Artificial Sequence: Synthetic peptide
  N-term acetylated
LSWAADMQAVVWDGLASGLDKDYLKPDD

SEQ ID NO: 413 - protein, 28 aa, Artificial Sequence
  Description of Artificial Sequence: Synthetic peptide
LSTAADLQAVVWDGLASGLDKDYLKPDD

SEQ ID NO: 414 - protein, 28 aa, Artificial Sequence
  Description of Artificial Sequence: Synthetic peptide
  N-term acetylated
LSTAADLQAVVWDGLASGLDKDYLKPDD

SEQ ID NO: 415 - protein, 28 aa, Artificial Sequence
  Description of Artificial Sequence: Synthetic peptide
LSWAADLQAVVWDGLASGLDKDYLKPDD

SEQ ID NO: 416 - protein, 28 aa, Artificial Sequence
  Description of Artificial Sequence: Synthetic peptide
  N-term acetylated
LSWAADLQAVVWDGLASGLDKDYLKPDD

SEQ ID NO: 417 - protein, 28 aa, Artificial Sequence
  Description of Artificial Sequence: Synthetic peptide
LSTAADVQAVVWDGLASGLDKDYLKPDD

SEQ ID NO: 418 - protein, 28 aa, Artificial Sequence
  Description of Artificial Sequence: Synthetic peptide
  N-term acetylated
LSTAADVQAVVWDGLASGLDKDYLKPDD

SEQ ID NO: 419 - protein, 28 aa, Artificial Sequence
  Description of Artificial Sequence: Synthetic peptide
LSWAADVQAVVWDGLASGLDKDYLKPDD

SEQ ID NO: 420 - protein, 28 aa, Artificial Sequence
  Description of Artificial Sequence: Synthetic peptide
  N-term acetylated
LSWAADVQAVVWDGLASGLDKDYLKPDD

SEQ ID NO: 421 - protein, 28 aa, Artificial Sequence
  Description of Artificial Sequence: Synthetic peptide
LSTAADMWAVVWDGLASGLDKDYLKPDD

SEQ ID NO: 422 - protein, 28 aa, Artificial Sequence
  Description of Artificial Sequence: Synthetic peptide
  N-term acetylated
LSTAADMWAVVWDGLASGLDKDYLKPDD

SEQ ID NO: 423 - protein, 28 aa, Artificial Sequence
  Description of Artificial Sequence: Synthetic peptide
LSWAADMWAVVWDGLASGLDKDYLKPDD

SEQ ID NO: 424 - protein, 28 aa, Artificial Sequence
  Description of Artificial Sequence: Synthetic peptide
  N-term acetylated
LSWAADMWAVVWDGLASGLDKDYLKPDD

SEQ ID NO: 425 - protein, 28 aa, Artificial Sequence
  Description of Artificial Sequence: Synthetic peptide
LSTAADLWAVVWDGLASGLDKDYLKPDD

SEQ ID NO: 426 - protein, 28 aa, Artificial Sequence
  Description of Artificial Sequence: Synthetic peptide
  N-term acetylated
LSTAADLWAVVWDGLASGLDKDYLKPDD

SEQ ID NO: 427 - protein, 28 aa, Artificial Sequence
  Description of Artificial Sequence: Synthetic peptide
LSWAADLWAVVWDGLASGLDKDYLKPDD

SEQ ID NO: 428 - protein, 28 aa, Artificial Sequence
  Description of Artificial Sequence: Synthetic peptide
  N-term acetylated
LSWAADLWAVVWDGLASGLDKDYLKPDD

SEQ ID NO: 429 - protein, 28 aa, Artificial Sequence
  Description of Artificial Sequence: Synthetic peptide
LSTAADVWAVVWDGLASGLDKDYLKPDD

SEQ ID NO: 430 - protein, 28 aa, Artificial Sequence
  Description of Artificial Sequence: Synthetic peptide
  N-term acetylated
LSTAADVWAVVWDGLASGLDKDYLKPDD

SEQ ID NO: 431 - protein, 28 aa, Artificial Sequence
  Description of Artificial Sequence: Synthetic peptide
LSWAADVWAVVWDGLASGLDKDYLKPDD

SEQ ID NO: 432 - protein, 28 aa, Artificial Sequence
  Description of Artificial Sequence: Synthetic peptide
  N-term acetylated
LSWAADVWAVVWDGLASGLDKDYLKPDD

SEQ ID NO: 433 - protein, 28 aa, Artificial Sequence
  Description of Artificial Sequence: Synthetic peptide
LSTAADMQGVVTDTLASGLDKDYLKPDD

SEQ ID NO: 434 - protein, 28 aa, Artificial Sequence
  Description of Artificial Sequence: Synthetic peptide
  N-term acetylated
LSTAADMQGVVTDTLASGLDKDYLKPDD

SEQ ID NO: 435 - protein, 28 aa, Artificial Sequence
  Description of Artificial Sequence: Synthetic peptide
LSWAADMQGVVTDTLASGLDKDYLKPDD

SEQ ID NO: 436 - protein, 28 aa, Artificial Sequence
  Description of Artificial Sequence: Synthetic peptide
  N-term acetylated
LSWAADMQGVVTDTLASGLDKDYLKPDD

SEQ ID NO: 437 - protein, 28 aa, Artificial Sequence
  Description of Artificial Sequence: Synthetic peptide
LSTAADLQGVVTDTLASGLDKDYLKPDD

SEQ ID NO: 438 - protein, 28 aa, Artificial Sequence
  Description of Artificial Sequence: Synthetic peptide
  N-term acetylated
LSTAADLQGVVTDTLASGLDKDYLKPDD

SEQ ID NO: 439 - protein, 28 aa, Artificial Sequence
  Description of Artificial Sequence: Synthetic peptide
LSWAADLQGVVTDTLASGLDKDYLKPDD

SEQ ID NO: 440 - protein, 28 aa, Artificial Sequence
  Description of Artificial Sequence: Synthetic peptide
  N-term acetylated
LSWAADLQGVVTDTLASGLDKDYLKPDD

SEQ ID NO: 441 - protein, 28 aa, Artificial Sequence
  Description of Artificial Sequence: Synthetic peptide
LSTAADVQGVVTDTLASGLDKDYLKPDD

SEQ ID NO: 442 - protein, 28 aa, Artificial Sequence
  Description of Artificial Sequence: Synthetic peptide
  N-term acetylated
LSTAADVQGVVTDTLASGLDKDYLKPDD

SEQ ID NO: 443 - protein, 28 aa, Artificial Sequence
  Description of Artificial Sequence: Synthetic peptide
LSWAADVQGVVTDTLASGLDKDYLKPDD

SEQ ID NO: 444 - protein, 28 aa, Artificial Sequence
  Description of Artificial Sequence: Synthetic peptide
  N-term acetylated
LSWAADVQGVVTDTLASGLDKDYLKPDD

SEQ ID NO: 445 - protein, 28 aa, Artificial Sequence
  Description of Artificial Sequence: Synthetic peptide
LSTAADMWGVVTDTLASGLDKDYLKPDD

SEQ ID NO: 446 - protein, 28 aa, Artificial Sequence
  Description of Artificial Sequence: Synthetic peptide
  N-term acetylated
LSTAADMWGVVTDTLASGLDKDYLKPDD

SEQ ID NO: 447 - protein, 28 aa, Artificial Sequence
  Description of Artificial Sequence: Synthetic peptide
LSWAADMWGVVTDTLASGLDKDYLKPDD

SEQ ID NO: 448 - protein, 28 aa, Artificial Sequence
  Description of Artificial Sequence: Synthetic peptide
  N-term acetylated
LSWAADMWGVVTDTLASGLDKDYLKPDD

SEQ ID NO: 449 - protein, 28 aa, Artificial Sequence
  Description of Artificial Sequence: Synthetic peptide
LSTAADLWGVVTDTLASGLDKDYLKPDD

SEQ ID NO: 450 - protein, 28 aa, Artificial Sequence
  Description of Artificial Sequence: Synthetic peptide
  N-term acetylated
LSTAADLWGVVTDTLASGLDKDYLKPDD

SEQ ID NO: 451 - protein, 28 aa, Artificial Sequence
  Description of Artificial Sequence: Synthetic peptide
LSWAADLWGVVTDTLASGLDKDYLKPDD

SEQ ID NO: 452 - protein, 28 aa, Artificial Sequence
  Description of Artificial Sequence: Synthetic peptide
  N-term acetylated
LSWAADLWGVVTDTLASGLDKDYLKPDD

SEQ ID NO: 453 - protein, 28 aa, Artificial Sequence
  Description of Artificial Sequence: Synthetic peptide
LSTAADVWGVVTDTLASGLDKDYLKPDD

SEQ ID NO: 454 - protein, 28 aa, Artificial Sequence
  Description of Artificial Sequence: Synthetic peptide
  N-term acetylated
LSTAADVWGVVTDTLASGLDKDYLKPDD

SEQ ID NO: 455 - protein, 28 aa, Artificial Sequence
  Description of Artificial Sequence: Synthetic peptide
LSWAADVWGVVTDTLASGLDKDYLKPDD

SEQ ID NO: 456 - protein, 28 aa, Artificial Sequence
  Description of Artificial Sequence: Synthetic peptide
  N-term acetylated
LSWAADVWGVVTDTLASGLDKDYLKPDD

SEQ ID NO: 457 - protein, 28 aa, Artificial Sequence
  Description of Artificial Sequence: Synthetic peptide
LSTAADMQAVVTDTLASGLDKDYLKPDD

SEQ ID NO: 458 - protein, 28 aa, Artificial Sequence
  Description of Artificial Sequence: Synthetic peptide
  N-term acetylated
LSTAADMQAVVTDTLASGLDKDYLKPDD

SEQ ID NO: 459 - protein, 28 aa, Artificial Sequence
  Description of Artificial Sequence: Synthetic peptide
LSWAADMQAVVTDTLASGLDKDYLKPDD

SEQ ID NO: 460 - protein, 28 aa, Artificial Sequence
  Description of Artificial Sequence: Synthetic peptide
  N-term acetylated
LSWAADMQAVVTDTLASGLDKDYLKPDD

SEQ ID NO: 461 - protein, 28 aa, Artificial Sequence
  Description of Artificial Sequence: Synthetic peptide
LSTAADLQAVVTDTLASGLDKDYLKPDD

SEQ ID NO: 462 - protein, 28 aa, Artificial Sequence
  Description of Artificial Sequence: Synthetic peptide
  N-term acetylated
LSTAADLQAVVTDTLASGLDKDYLKPDD

SEQ ID NO: 463 - protein, 28 aa, Artificial Sequence
  Description of Artificial Sequence: Synthetic peptide
LSWAADLQAVVTDTLASGLDKDYLKPDD

SEQ ID NO: 464 - protein, 28 aa, Artificial Sequence
  Description of Artificial Sequence: Synthetic peptide
  N-term acetylated
LSWAADLQAVVTDTLASGLDKDYLKPDD

SEQ ID NO: 465 - protein, 28 aa, Artificial Sequence
  Description of Artificial Sequence: Synthetic peptide
LSTAADVQAVVTDTLASGLDKDYLKPDD

SEQ ID NO: 466 - protein, 28 aa, Artificial Sequence
  Description of Artificial Sequence: Synthetic peptide
  N-term acetylated
LSTAADVQAVVTDTLASGLDKDYLKPDD

SEQ ID NO: 467 - protein, 28 aa, Artificial Sequence
  Description of Artificial Sequence: Synthetic peptide
LSWAADVQAVVTDTLASGLDKDYLKPDD

SEQ ID NO: 468 - protein, 28 aa, Artificial Sequence
  Description of Artificial Sequence: Synthetic peptide
  N-term acetylated
LSWAADVQAVVTDTLASGLDKDYLKPDD

SEQ ID NO: 469 - protein, 28 aa, Artificial Sequence
  Description of Artificial Sequence: Synthetic peptide
LSTAADMWAVVTDTLASGLDKDYLKPDD

SEQ ID NO: 470 - protein, 28 aa, Artificial Sequence
  Description of Artificial Sequence: Synthetic peptide
  N-term acetylated
LSTAADMWAVVTDTLASGLDKDYLKPDD

SEQ ID NO: 471 - protein, 28 aa, Artificial Sequence
  Description of Artificial Sequence: Synthetic peptide
LSWAADMWAVVTDTLASGLDKDYLKPDD

SEQ ID NO: 472 - protein, 28 aa, Artificial Sequence
  Description of Artificial Sequence: Synthetic peptide
  N-term acetylated
LSWAADMWAVVTDTLASGLDKDYLKPDD

SEQ ID NO: 473 - protein, 28 aa, Artificial Sequence
  Description of Artificial Sequence: Synthetic peptide
LSTAADLWAVVTDTLASGLDKDYLKPDD

SEQ ID NO: 474 - protein, 28 aa, Artificial Sequence
  Description of Artificial Sequence: Synthetic peptide
  N-term acetylated
LSTAADLWAVVTDTLASGLDKDYLKPDD

SEQ ID NO: 475 - protein, 28 aa, Artificial Sequence
  Description of Artificial Sequence: Synthetic peptide
LSWAADLWAVVTDTLASGLDKDYLKPDD

SEQ ID NO: 476 - protein, 28 aa, Artificial Sequence
  Description of Artificial Sequence: Synthetic peptide
  N-term acetylated
LSWAADLWAVVTDTLASGLDKDYLKPDD

SEQ ID NO: 477 - protein, 28 aa, Artificial Sequence
  Description of Artificial Sequence: Synthetic peptide
LSTAADVWAVVTDTLASGLDKDYLKPDD

SEQ ID NO: 478 - protein, 28 aa, Artificial Sequence
  Description of Artificial Sequence: Synthetic peptide
  N-term acetylated
LSTAADVWAVVTDTLASGLDKDYLKPDD

SEQ ID NO: 479 - protein, 28 aa, Artificial Sequence
  Description of Artificial Sequence: Synthetic peptide
LSWAADVWAVVTDTLASGLDKDYLKPDD

SEQ ID NO: 480 - protein, 28 aa, Artificial Sequence
  Description of Artificial Sequence: Synthetic peptide
  N-term acetylated
LSWAADVWAVVTDTLASGLDKDYLKPDD

SEQ ID NO: 481 - protein, 28 aa, Artificial Sequence
  Description of Artificial Sequence: Synthetic peptide
LSTAADMQGVVWDTLASGLDKDYLKPDD

SEQ ID NO: 482 - protein, 28 aa, Artificial Sequence
  Description of Artificial Sequence: Synthetic peptide
  N-term acetylated
LSTAADMQGVVWDTLASGLDKDYLKPDD

SEQ ID NO: 483 - protein, 28 aa, Artificial Sequence
  Description of Artificial Sequence: Synthetic peptide
LSWAADMQGVVWDTLASGLDKDYLKPDD

SEQ ID NO: 484 - protein, 28 aa, Artificial Sequence
  Description of Artificial Sequence: Synthetic peptide
  N-term acetylated
LSWAADMQGVVWDTLASGLDKDYLKPDD

SEQ ID NO: 485 - protein, 28 aa, Artificial Sequence
  Description of Artificial Sequence: Synthetic peptide
LSTAADLQGVVWDTLASGLDKDYLKPDD

SEQ ID NO: 486 - protein, 28 aa, Artificial Sequence
  Description of Artificial Sequence: Synthetic peptide
  N-term acetylated
LSTAADLQGVVWDTLASGLDKDYLKPDD

SEQ ID NO: 487 - protein, 28 aa, Artificial Sequence
  Description of Artificial Sequence: Synthetic peptide
LSWAADLQGVVWDTLASGLDKDYLKPDD

SEQ ID NO: 488 - protein, 28 aa, Artificial Sequence
  Description of Artificial Sequence: Synthetic peptide
  N-term acetylated
LSWAADLQGVVWDTLASGLDKDYLKPDD

SEQ ID NO: 489 - protein, 28 aa, Artificial Sequence
  Description of Artificial Sequence: Synthetic peptide
LSTAADVQGVVWDTLASGLDKDYLKPDD

SEQ ID NO: 490 - protein, 28 aa, Artificial Sequence
  Description of Artificial Sequence: Synthetic peptide
  N-term acetylated
LSTAADVQGVVWDTLASGLDKDYLKPDD

SEQ ID NO: 491 - protein, 28 aa, Artificial Sequence
  Description of Artificial Sequence: Synthetic peptide
LSWAADVQGVVWDTLASGLDKDYLKPDD

SEQ ID NO: 492 - protein, 28 aa, Artificial Sequence
  Description of Artificial Sequence: Synthetic peptide
  N-term acetylated
LSWAADVQGVVWDTLASGLDKDYLKPDD

SEQ ID NO: 493 - protein, 28 aa, Artificial Sequence
  Description of Artificial Sequence: Synthetic peptide
LSTAADMWGVVWDTLASGLDKDYLKPDD

SEQ ID NO: 494 - protein, 28 aa, Artificial Sequence
  Description of Artificial Sequence: Synthetic peptide
  N-term acetylated
LSTAADMWGVVWDTLASGLDKDYLKPDD

SEQ ID NO: 495 - protein, 28 aa, Artificial Sequence
  Description of Artificial Sequence: Synthetic peptide
LSWAADMWGVVWDTLASGLDKDYLKPDD

SEQ ID NO: 496 - protein, 28 aa, Artificial Sequence
  Description of Artificial Sequence: Synthetic peptide
  N-term acetylated
LSWAADMWGVVWDTLASGLDKDYLKPDD

SEQ ID NO: 497 - protein, 28 aa, Artificial Sequence
  Description of Artificial Sequence: Synthetic peptide
LSTAADLWGVVWDTLASGLDKDYLKPDD

SEQ ID NO: 498 - protein, 28 aa, Artificial Sequence
  Description of Artificial Sequence: Synthetic peptide
  N-term acetylated
LSTAADLWGVVWDTLASGLDKDYLKPDD

SEQ ID NO: 499 - protein, 28 aa, Artificial Sequence
  Description of Artificial Sequence: Synthetic peptide
LSWAADLWGVVWDTLASGLDKDYLKPDD

SEQ ID NO: 500 - protein, 28 aa, Artificial Sequence
  Description of Artificial Sequence: Synthetic peptide
  N-term acetylated
LSWAADLWGVVWDTLASGLDKDYLKPDD

SEQ ID NO: 501 - protein, 28 aa, Artificial Sequence
  Description of Artificial Sequence: Synthetic peptide
LSTAADVWGVVWDTLASGLDKDYLKPDD

SEQ ID NO: 502 - protein, 28 aa, Artificial Sequence
  Description of Artificial Sequence: Synthetic peptide
  N-term acetylated
LSTAADVWGVVWDTLASGLDKDYLKPDD

SEQ ID NO: 503 - protein, 28 aa, Artificial Sequence
  Description of Artificial Sequence: Synthetic peptide
LSWAADVWGVVWDTLASGLDKDYLKPDD

SEQ ID NO: 504 - protein, 28 aa, Artificial Sequence
  Description of Artificial Sequence: Synthetic peptide
  N-term acetylated
LSWAADVWGVVWDTLASGLDKDYLKPDD

SEQ ID NO: 505 - protein, 28 aa, Artificial Sequence
  Description of Artificial Sequence: Synthetic peptide
LSTAADMQAVVWDTLASGLDKDYLKPDD

SEQ ID NO: 506 - protein, 28 aa, Artificial Sequence
  Description of Artificial Sequence: Synthetic peptide
  N-term acetylated
LSTAADMQAVVWDTLASGLDKDYLKPDD

SEQ ID NO: 507 - protein, 28 aa, Artificial Sequence
  Description of Artificial Sequence: Synthetic peptide
LSWAADMQAVVWDTLASGLDKDYLKPDD

SEQ ID NO: 508 - protein, 28 aa, Artificial Sequence
  Description of Artificial Sequence: Synthetic peptide
  N-term acetylated
LSWAADMQAVVWDTLASGLDKDYLKPDD

SEQ ID NO: 509 - protein, 28 aa, Artificial Sequence
  Description of Artificial Sequence: Synthetic peptide
LSTAADLQAVVWDTLASGLDKDYLKPDD

SEQ ID NO: 510 - protein, 28 aa, Artificial Sequence
  Description of Artificial Sequence: Synthetic peptide
  N-term acetylated
LSTAADLQAVVWDTLASGLDKDYLKPDD

SEQ ID NO: 511 - protein, 28 aa, Artificial Sequence
  Description of Artificial Sequence: Synthetic peptide
LSWAADLQAVVWDTLASGLDKDYLKPDD

SEQ ID NO: 512 - protein, 28 aa, Artificial Sequence
  Description of Artificial Sequence: Synthetic peptide
  N-term acetylated
LSWAADLQAVVWDTLASGLDKDYLKPDD

SEQ ID NO: 513 - protein, 28 aa, Artificial Sequence
  Description of Artificial Sequence: Synthetic peptide
LSTAADVQAVVWDTLASGLDKDYLKPDD

SEQ ID NO: 514 - protein, 28 aa, Artificial Sequence
  Description of Artificial Sequence: Synthetic peptide
  N-term acetylated
LSTAADVQAVVWDTLASGLDKDYLKPDD

SEQ ID NO: 515 - protein, 28 aa, Artificial Sequence
  Description of Artificial Sequence: Synthetic peptide
LSWAADVQAVVWDTLASGLDKDYLKPDD

SEQ ID NO: 516 - protein, 28 aa, Artificial Sequence
  Description of Artificial Sequence: Synthetic peptide
  N-term acetylated
LSWAADVQAVVWDTLASGLDKDYLKPDD

SEQ ID NO: 517 - protein, 28 aa, Artificial Sequence
  Description of Artificial Sequence: Synthetic peptide
LSTAADMWAVVWDTLASGLDKDYLKPDD

SEQ ID NO: 518 - protein, 28 aa, Artificial Sequence
  Description of Artificial Sequence: Synthetic peptide
  N-term acetylated
LSTAADMWAVVWDTLASGLDKDYLKPDD

SEQ ID NO: 519 - protein, 28 aa, Artificial Sequence
  Description of Artificial Sequence: Synthetic peptide
LSWAADMWAVVWDTLASGLDKDYLKPDD

SEQ ID NO: 520 - protein, 28 aa, Artificial Sequence
  Description of Artificial Sequence: Synthetic peptide
  N-term acetylated
LSWAADMWAVVWDTLASGLDKDYLKPDD

SEQ ID NO: 521 - protein, 28 aa, Artificial Sequence
  Description of Artificial Sequence: Synthetic peptide
LSTAADLWAVVWDTLASGLDKDYLKPDD

SEQ ID NO: 522 - protein, 28 aa, Artificial Sequence
  Description of Artificial Sequence: Synthetic peptide
  N-term acetylated
LSTAADLWAVVWDTLASGLDKDYLKPDD

SEQ ID NO: 523 - protein, 28 aa, Artificial Sequence
  Description of Artificial Sequence: Synthetic peptide
LSWAADLWAVVWDTLASGLDKDYLKPDD

SEQ ID NO: 524 - protein, 28 aa, Artificial Sequence
  Description of Artificial Sequence: Synthetic peptide
  N-term acetylated
LSWAADLWAVVWDTLASGLDKDYLKPDD

SEQ ID NO: 525 - protein, 28 aa, Artificial Sequence
  Description of Artificial Sequence: Synthetic peptide
LSTAADVWAVVWDTLASGLDKDYLKPDD

SEQ ID NO: 526 - protein, 28 aa, Artificial Sequence
  Description of Artificial Sequence: Synthetic peptide
  N-term acetylated
LSTAADVWAVVWDTLASGLDKDYLKPDD

SEQ ID NO: 527 - protein, 28 aa, Artificial Sequence
  Description of Artificial Sequence: Synthetic peptide
LSWAADVWAVVWDTLASGLDKDYLKPDD

SEQ ID NO: 528 - protein, 28 aa, Artificial Sequence
  Description of Artificial Sequence: Synthetic peptide
  N-term acetylated
LSWAADVWAVVWDTLASGLDKDYLKPDD

SEQ ID NO: 529 - protein, 28 aa, Artificial Sequence
  Description of Artificial Sequence: Synthetic peptide
LSTAADMQGVVTDWLASGLDKDYLKPDD

SEQ ID NO: 530 - protein, 28 aa, Artificial Sequence
  Description of Artificial Sequence: Synthetic peptide
  N-term acetylated
LSTAADMQGVVTDWLASGLDKDYLKPDD

SEQ ID NO: 531 - protein, 28 aa, Artificial Sequence
  Description of Artificial Sequence: Synthetic peptide
LSWAADMQGVVTDWLASGLDKDYLKPDD

SEQ ID NO: 532 - protein, 28 aa, Artificial Sequence
  Description of Artificial Sequence: Synthetic peptide
  N-term acetylated
LSWAADMQGVVTDWLASGLDKDYLKPDD

SEQ ID NO: 533 - protein, 28 aa, Artificial Sequence
  Description of Artificial Sequence: Synthetic peptide
LSTAADLQGVVTDWLASGLDKDYLKPDD

SEQ ID NO: 534 - protein, 28 aa, Artificial Sequence
  Description of Artificial Sequence: Synthetic peptide
  N-term acetylated
LSTAADLQGVVTDWLASGLDKDYLKPDD

SEQ ID NO: 535 - protein, 28 aa, Artificial Sequence
  Description of Artificial Sequence: Synthetic peptide
LSWAADLQGVVTDWLASGLDKDYLKPDD

SEQ ID NO: 536 - protein, 28 aa, Artificial Sequence
  Description of Artificial Sequence: Synthetic peptide
  N-term acetylated
LSWAADLQGVVTDWLASGLDKDYLKPDD

SEQ ID NO: 537 - protein, 28 aa, Artificial Sequence
  Description of Artificial Sequence: Synthetic peptide
LSTAADVQGVVTDWLASGLDKDYLKPDD

SEQ ID NO: 538 - protein, 28 aa, Artificial Sequence
  Description of Artificial Sequence: Synthetic peptide
  N-term acetylated
LSTAADVQGVVTDWLASGLDKDYLKPDD

SEQ ID NO: 539 - protein, 28 aa, Artificial Sequence
  Description of Artificial Sequence: Synthetic peptide
LSWAADVQGVVTDWLASGLDKDYLKPDD

SEQ ID NO: 540 - protein, 28 aa, Artificial Sequence
  Description of Artificial Sequence: Synthetic peptide
  N-term acetylated
LSWAADVQGVVTDWLASGLDKDYLKPDD

SEQ ID NO: 541 - protein, 28 aa, Artificial Sequence
  Description of Artificial Sequence: Synthetic peptide
LSTAADMWGVVTDWLASGLDKDYLKPDD

SEQ ID NO: 542 - protein, 28 aa, Artificial Sequence
  Description of Artificial Sequence: Synthetic peptide
  N-term acetylated
LSTAADMWGVVTDWLASGLDKDYLKPDD

SEQ ID NO: 543 - protein, 28 aa, Artificial Sequence
  Description of Artificial Sequence: Synthetic peptide
LSWAADMWGVVTDWLASGLDKDYLKPDD

SEQ ID NO: 544 - protein, 28 aa, Artificial Sequence
  Description of Artificial Sequence: Synthetic peptide
  N-term acetylated
LSWAADMWGVVTDWLASGLDKDYLKPDD

SEQ ID NO: 545 - protein, 28 aa, Artificial Sequence
  Description of Artificial Sequence: Synthetic peptide
LSTAADLWGVVTDWLASGLDKDYLKPDD

SEQ ID NO: 546 - protein, 28 aa, Artificial Sequence
  Description of Artificial Sequence: Synthetic peptide
  N-term acetylated
LSTAADLWGVVTDWLASGLDKDYLKPDD

SEQ ID NO: 547 - protein, 28 aa, Artificial Sequence
  Description of Artificial Sequence: Synthetic peptide
LSWAADLWGVVTDWLASGLDKDYLKPDD

SEQ ID NO: 548 - protein, 28 aa, Artificial Sequence
  Description of Artificial Sequence: Synthetic peptide
  N-term acetylated
LSWAADLWGVVTDWLASGLDKDYLKPDD

SEQ ID NO: 549 - protein, 28 aa, Artificial Sequence
  Description of Artificial Sequence: Synthetic peptide
LSTAADVWGVVTDWLASGLDKDYLKPDD

SEQ ID NO: 550 - protein, 28 aa, Artificial Sequence
  Description of Artificial Sequence: Synthetic peptide
  N-term acetylated
LSTAADVWGVVTDWLASGLDKDYLKPDD

SEQ ID NO: 551 - protein, 28 aa, Artificial Sequence
  Description of Artificial Sequence: Synthetic peptide
LSWAADVWGVVTDWLASGLDKDYLKPDD

SEQ ID NO: 552 - protein, 28 aa, Artificial Sequence
  Description of Artificial Sequence: Synthetic peptide
  N-term acetylated
LSWAADVWGVVTDWLASGLDKDYLKPDD

SEQ ID NO: 553 - protein, 28 aa, Artificial Sequence
  Description of Artificial Sequence: Synthetic peptide
LSTAADMQAVVTDWLASGLDKDYLKPDD

SEQ ID NO: 554 - protein, 28 aa, Artificial Sequence
  Description of Artificial Sequence: Synthetic peptide
  N-term acetylated
LSTAADMQAVVTDWLASGLDKDYLKPDD

SEQ ID NO: 555 - protein, 28 aa, Artificial Sequence
  Description of Artificial Sequence: Synthetic peptide
LSWAADMQAVVTDWLASGLDKDYLKPDD

SEQ ID NO: 556 - protein, 28 aa, Artificial Sequence
  Description of Artificial Sequence: Synthetic peptide
  N-term acetylated
LSWAADMQAVVTDWLASGLDKDYLKPDD

SEQ ID NO: 557 - protein, 28 aa, Artificial Sequence
  Description of Artificial Sequence: Synthetic peptide
LSTAADLQAVVTDWLASGLDKDYLKPDD

SEQ ID NO: 558 - protein, 28 aa, Artificial Sequence
  Description of Artificial Sequence: Synthetic peptide
  N-term acetylated
LSTAADLQAVVTDWLASGLDKDYLKPDD

SEQ ID NO: 559 - protein, 28 aa, Artificial Sequence
  Description of Artificial Sequence: Synthetic peptide
LSWAADLQAVVTDWLASGLDKDYLKPDD

SEQ ID NO: 560 - protein, 28 aa, Artificial Sequence
  Description of Artificial Sequence: Synthetic peptide
  N-term acetylated
LSWAADLQAVVTDWLASGLDKDYLKPDD

SEQ ID NO: 561 - protein, 28 aa, Artificial Sequence
  Description of Artificial Sequence: Synthetic peptide
LSTAADVQAVVTDWLASGLDKDYLKPDD

SEQ ID NO: 562 - protein, 28 aa, Artificial Sequence
  Description of Artificial Sequence: Synthetic peptide
  N-term acetylated
LSTAADVQAVVTDWLASGLDKDYLKPDD

SEQ ID NO: 563 - protein, 28 aa, Artificial Sequence
  Description of Artificial Sequence: Synthetic peptide
LSWAADVQAVVTDWLASGLDKDYLKPDD

SEQ ID NO: 564 - protein, 28 aa, Artificial Sequence
  Description of Artificial Sequence: Synthetic peptide
  N-term acetylated
LSWAADVQAVVTDWLASGLDKDYLKPDD

SEQ ID NO: 565 - protein, 28 aa, Artificial Sequence
  Description of Artificial Sequence: Synthetic peptide
LSTAADMWAVVTDWLASGLDKDYLKPDD

SEQ ID NO: 566 - protein, 28 aa, Artificial Sequence
  Description of Artificial Sequence: Synthetic peptide
  N-term acetylated
LSTAADMWAVVTDWLASGLDKDYLKPDD

SEQ ID NO: 567 - protein, 28 aa, Artificial Sequence
  Description of Artificial Sequence: Synthetic peptide
LSWAADMWAVVTDWLASGLDKDYLKPDD

SEQ ID NO: 568 - protein, 28 aa, Artificial Sequence
  Description of Artificial Sequence: Synthetic peptide
  N-term acetylated
LSWAADMWAVVTDWLASGLDKDYLKPDD

SEQ ID NO: 569 - protein, 28 aa, Artificial Sequence
  Description of Artificial Sequence: Synthetic peptide
LSTAADLWAVVTDWLASGLDKDYLKPDD

SEQ ID NO: 570 - protein, 28 aa, Artificial Sequence
  Description of Artificial Sequence: Synthetic peptide
  N-term acetylated
LSTAADLWAVVTDWLASGLDKDYLKPDD

SEQ ID NO: 571 - protein, 28 aa, Artificial Sequence
  Description of Artificial Sequence: Synthetic peptide
LSWAADLWAVVTDWLASGLDKDYLKPDD

SEQ ID NO: 572 - protein, 28 aa, Artificial Sequence
  Description of Artificial Sequence: Synthetic peptide
  N-term acetylated
LSWAADLWAVVTDWLASGLDKDYLKPDD

SEQ ID NO: 573 - protein, 28 aa, Artificial Sequence
  Description of Artificial Sequence: Synthetic peptide
LSTAADVWAVVTDWLASGLDKDYLKPDD

SEQ ID NO: 574 - protein, 28 aa, Artificial Sequence
  Description of Artificial Sequence: Synthetic peptide
  N-term acetylated
LSTAADVWAVVTDWLASGLDKDYLKPDD

SEQ ID NO: 575 - protein, 28 aa, Artificial Sequence
  Description of Artificial Sequence: Synthetic peptide
LSWAADVWAVVTDWLASGLDKDYLKPDD

SEQ ID NO: 576 - protein, 28 aa, Artificial Sequence
  Description of Artificial Sequence: Synthetic peptide
  N-term acetylated
LSWAADVWAVVTDWLASGLDKDYLKPDD

SEQ ID NO: 577 - protein, 28 aa, Artificial Sequence
  Description of Artificial Sequence: Synthetic peptide
LSTAADMQGVVWDWLASGLDKDYLKPDD

SEQ ID NO: 578 - protein, 28 aa, Artificial Sequence
  Description of Artificial Sequence: Synthetic peptide
  N-term acetylated
LSTAADMQGVVWDWLASGLDKDYLKPDD

SEQ ID NO: 579 - protein, 28 aa, Artificial Sequence
  Description of Artificial Sequence: Synthetic peptide
LSWAADMQGVVWDWLASGLDKDYLKPDD

SEQ ID NO: 580 - protein, 28 aa, Artificial Sequence
  Description of Artificial Sequence: Synthetic peptide
  N-term acetylated
LSWAADMQGVVWDWLASGLDKDYLKPDD

SEQ ID NO: 581 - protein, 28 aa, Artificial Sequence
  Description of Artificial Sequence: Synthetic peptide
LSTAADLQGVVWDWLASGLDKDYLKPDD

SEQ ID NO: 582 - protein, 28 aa, Artificial Sequence
  Description of Artificial Sequence: Synthetic peptide
  N-term acetylated
LSTAADLQGVVWDWLASGLDKDYLKPDD

SEQ ID NO: 583 - protein, 28 aa, Artificial Sequence
  Description of Artificial Sequence: Synthetic peptide
LSWAADLQGVVWDWLASGLDKDYLKPDD

SEQ ID NO: 584 - protein, 28 aa, Artificial Sequence
  Description of Artificial Sequence: Synthetic peptide
  N-term acetylated
LSWAADLQGVVWDWLASGLDKDYLKPDD

SEQ ID NO: 585 - protein, 28 aa, Artificial Sequence
  Description of Artificial Sequence: Synthetic peptide
LSTAADVQGVVWDWLASGLDKDYLKPDD

SEQ ID NO: 586 - protein, 28 aa, Artificial Sequence
  Description of Artificial Sequence: Synthetic peptide
  N-term acetylated
LSTAADVQGVVWDWLASGLDKDYLKPDD

SEQ ID NO: 587 - protein, 28 aa, Artificial Sequence
  Description of Artificial Sequence: Synthetic peptide
LSWAADVQGVVWDWLASGLDKDYLKPDD

SEQ ID NO: 588 - protein, 28 aa, Artificial Sequence
  Description of Artificial Sequence: Synthetic peptide
  N-term acetylated
LSWAADVQGVVWDWLASGLDKDYLKPDD

SEQ ID NO: 589 - protein, 28 aa, Artificial Sequence
  Description of Artificial Sequence: Synthetic peptide
LSTAADMWGVVWDWLASGLDKDYLKPDD

SEQ ID NO: 590 - protein, 28 aa, Artificial Sequence
  Description of Artificial Sequence: Synthetic peptide
  N-term acetylated
LSTAADMWGVVWDWLASGLDKDYLKPDD

SEQ ID NO: 591 - protein, 28 aa, Artificial Sequence
  Description of Artificial Sequence: Synthetic peptide
LSWAADMWGVVWDWLASGLDKDYLKPDD

SEQ ID NO: 592 - protein, 28 aa, Artificial Sequence
  Description of Artificial Sequence: Synthetic peptide
  N-term acetylated
LSWAADMWGVVWDWLASGLDKDYLKPDD

SEQ ID NO: 593 - protein, 28 aa, Artificial Sequence
  Description of Artificial Sequence: Synthetic peptide
LSTAADLWGVVWDWLASGLDKDYLKPDD

SEQ ID NO: 594 - protein, 28 aa, Artificial Sequence
  Description of Artificial Sequence: Synthetic peptide
  N-term acetylated
LSTAADLWGVVWDWLASGLDKDYLKPDD

SEQ ID NO: 595 - protein, 28 aa, Artificial Sequence
  Description of Artificial Sequence: Synthetic peptide
LSWAADLWGVVWDWLASGLDKDYLKPDD

SEQ ID NO: 596 - protein, 28 aa, Artificial Sequence
  Description of Artificial Sequence: Synthetic peptide
  N-term acetylated
LSWAADLWGVVWDWLASGLDKDYLKPDD

SEQ ID NO: 597 - protein, 28 aa, Artificial Sequence
  Description of Artificial Sequence: Synthetic peptide
LSTAADVWGVVWDWLASGLDKDYLKPDD

SEQ ID NO: 598 - protein, 28 aa, Artificial Sequence
  Description of Artificial Sequence: Synthetic peptide
  N-term acetylated
LSTAADVWGVVWDWLASGLDKDYLKPDD

SEQ ID NO: 599 - protein, 28 aa, Artificial Sequence
  Description of Artificial Sequence: Synthetic peptide
LSWAADVWGVVWDWLASGLDKDYLKPDD

SEQ ID NO: 600 - protein, 28 aa, Artificial Sequence
  Description of Artificial Sequence: Synthetic peptide
  N-term acetylated
LSWAADVWGVVWDWLASGLDKDYLKPDD

SEQ ID NO: 601 - protein, 28 aa, Artificial Sequence
  Description of Artificial Sequence: Synthetic peptide
LSTAADMQAVVWDWLASGLDKDYLKPDD

SEQ ID NO: 602 - protein, 28 aa, Artificial Sequence
  Description of Artificial Sequence: Synthetic peptide
  N-term acetylated
LSTAADMQAVVWDWLASGLDKDYLKPDD

SEQ ID NO: 603 - protein, 28 aa, Artificial Sequence
  Description of Artificial Sequence: Synthetic peptide
LSWAADMQAVVWDWLASGLDKDYLKPDD

SEQ ID NO: 604 - protein, 28 aa, Artificial Sequence
  Description of Artificial Sequence: Synthetic peptide
  N-term acetylated
LSWAADMQAVVWDWLASGLDKDYLKPDD

SEQ ID NO: 605 - protein, 28 aa, Artificial Sequence
  Description of Artificial Sequence: Synthetic peptide
LSTAADLQAVVWDWLASGLDKDYLKPDD

SEQ ID NO: 606 - protein, 28 aa, Artificial Sequence
  Description of Artificial Sequence: Synthetic peptide
  N-term acetylated
LSTAADLQAVVWDWLASGLDKDYLKPDD

SEQ ID NO: 607 - protein, 28 aa, Artificial Sequence
  Description of Artificial Sequence: Synthetic peptide
LSWAADLQAVVWDWLASGLDKDYLKPDD

SEQ ID NO: 608 - protein, 28 aa, Artificial Sequence
  Description of Artificial Sequence: Synthetic peptide
  N-term acetylated
LSWAADLQAVVWDWLASGLDKDYLKPDD

SEQ ID NO: 609 - protein, 28 aa, Artificial Sequence
  Description of Artificial Sequence: Synthetic peptide
LSTAADVQAVVWDWLASGLDKDYLKPDD

SEQ ID NO: 610 - protein, 28 aa, Artificial Sequence
  Description of Artificial Sequence: Synthetic peptide
  N-term acetylated
LSTAADVQAVVWDWLASGLDKDYLKPDD

SEQ ID NO: 611 - protein, 28 aa, Artificial Sequence
  Description of Artificial Sequence: Synthetic peptide
LSWAADVQAVVWDWLASGLDKDYLKPDD

SEQ ID NO: 612 - protein, 28 aa, Artificial Sequence
  Description of Artificial Sequence: Synthetic peptide
  N-term acetylated
LSWAADVQAVVWDWLASGLDKDYLKPDD

SEQ ID NO: 613 - protein, 28 aa, Artificial Sequence
  Description of Artificial Sequence: Synthetic peptide
LSTAADMWAVVWDWLASGLDKDYLKPDD

SEQ ID NO: 614 - protein, 28 aa, Artificial Sequence
  Description of Artificial Sequence: Synthetic peptide
  N-term acetylated
LSTAADMWAVVWDWLASGLDKDYLKPDD

SEQ ID NO: 615 - protein, 28 aa, Artificial Sequence
  Description of Artificial Sequence: Synthetic peptide
LSWAADMWAVVWDWLASGLDKDYLKPDD

SEQ ID NO: 616 - protein, 28 aa, Artificial Sequence
  Description of Artificial Sequence: Synthetic peptide
  N-term acetylated
LSWAADMWAVVWDWLASGLDKDYLKPDD

SEQ ID NO: 617 - protein, 28 aa, Artificial Sequence
  Description of Artificial Sequence: Synthetic peptide
LSTAADLWAVVWDWLASGLDKDYLKPDD

SEQ ID NO: 618 - protein, 28 aa, Artificial Sequence
  Description of Artificial Sequence: Synthetic peptide
  N-term acetylated
LSTAADLWAVVWDWLASGLDKDYLKPDD

SEQ ID NO: 619 - protein, 28 aa, Artificial Sequence
  Description of Artificial Sequence: Synthetic peptide
LSWAADLWAVVWDWLASGLDKDYLKPDD

SEQ ID NO: 620 - protein, 28 aa, Artificial Sequence
  Description of Artificial Sequence: Synthetic peptide
  N-term acetylated
LSWAADLWAVVWDWLASGLDKDYLKPDD

SEQ ID NO: 621 - protein, 28 aa, Artificial Sequence
  Description of Artificial Sequence: Synthetic peptide
LSTAADVWAVVWDWLASGLDKDYLKPDD

SEQ ID NO: 622 - protein, 28 aa, Artificial Sequence
  Description of Artificial Sequence: Synthetic peptide
  N-term acetylated
LSTAADVWAVVWDWLASGLDKDYLKPDD

SEQ ID NO: 623 - protein, 28 aa, Artificial Sequence
  Description of Artificial Sequence: Synthetic peptide
LSWAADVWAVVWDWLASGLDKDYLKPDD

SEQ ID NO: 624 - protein, 28 aa, Artificial Sequence
  Description of Artificial Sequence: Synthetic peptide
  N-term acetylated
LSWAADVWAVVWDWLASGLDKDYLKPDD

SEQ ID NO: 625 - protein, 28 aa, Artificial Sequence
  Description of Artificial Sequence: Synthetic peptide
LSTAADMQGVVTDGVASGLDKDYLKPDD

SEQ ID NO: 626 - protein, 28 aa, Artificial Sequence
  Description of Artificial Sequence: Synthetic peptide
  N-term acetylated
LSTAADMQGVVTDGVASGLDKDYLKPDD

SEQ ID NO: 627 - protein, 28 aa, Artificial Sequence
  Description of Artificial Sequence: Synthetic peptide
LSWAADMQGVVTDGVASGLDKDYLKPDD

SEQ ID NO: 628 - protein, 28 aa, Artificial Sequence
  Description of Artificial Sequence: Synthetic peptide
  N-term acetylated
LSWAADMQGVVTDGVASGLDKDYLKPDD

SEQ ID NO: 629 - protein, 28 aa, Artificial Sequence
  Description of Artificial Sequence: Synthetic peptide
LSTAADLQGVVTDGVASGLDKDYLKPDD

SEQ ID NO: 630 - protein, 28 aa, Artificial Sequence
  Description of Artificial Sequence: Synthetic peptide
  N-term acetylated
LSTAADLQGVVTDGVASGLDKDYLKPDD

SEQ ID NO: 631 - protein, 28 aa, Artificial Sequence
  Description of Artificial Sequence: Synthetic peptide
LSWAADLQGVVTDGVASGLDKDYLKPDD

SEQ ID NO: 632 - protein, 28 aa, Artificial Sequence
  Description of Artificial Sequence: Synthetic peptide
  N-term acetylated
LSWAADLQGVVTDGVASGLDKDYLKPDD

SEQ ID NO: 633 - protein, 28 aa, Artificial Sequence
  Description of Artificial Sequence: Synthetic peptide
LSTAADVQGVVTDGVASGLDKDYLKPDD

SEQ ID NO: 634 - protein, 28 aa, Artificial Sequence
  Description of Artificial Sequence: Synthetic peptide
  N-term acetylated
LSTAADVQGVVTDGVASGLDKDYLKPDD

SEQ ID NO: 635 - protein, 28 aa, Artificial Sequence
  Description of Artificial Sequence: Synthetic peptide
LSWAADVQGVVTDGVASGLDKDYLKPDD

SEQ ID NO: 636 - protein, 28 aa, Artificial Sequence
  Description of Artificial Sequence: Synthetic peptide
  N-term acetylated
LSWAADVQGVVTDGVASGLDKDYLKPDD

SEQ ID NO: 637 - protein, 28 aa, Artificial Sequence
  Description of Artificial Sequence: Synthetic peptide
LSTAADMWGVVTDGVASGLDKDYLKPDD

SEQ ID NO: 638 - protein, 28 aa, Artificial Sequence
  Description of Artificial Sequence: Synthetic peptide
  N-term acetylated
LSTAADMWGVVTDGVASGLDKDYLKPDD

SEQ ID NO: 639 - protein, 28 aa, Artificial Sequence
  Description of Artificial Sequence: Synthetic peptide
LSWAADMWGVVTDGVASGLDKDYLKPDD

SEQ ID NO: 640 - protein, 28 aa, Artificial Sequence
  Description of Artificial Sequence: Synthetic peptide
  N-term acetylated
LSWAADMWGVVTDGVASGLDKDYLKPDD

SEQ ID NO: 641 - protein, 28 aa, Artificial Sequence
  Description of Artificial Sequence: Synthetic peptide
LSTAADLWGVVTDGVASGLDKDYLKPDD

SEQ ID NO: 642 - protein, 28 aa, Artificial Sequence
  Description of Artificial Sequence: Synthetic peptide
  N-term acetylated
LSTAADLWGVVTDGVASGLDKDYLKPDD

SEQ ID NO: 643 - protein, 28 aa, Artificial Sequence
  Description of Artificial Sequence: Synthetic peptide
LSWAADLWGVVTDGVASGLDKDYLKPDD

SEQ ID NO: 644 - protein, 28 aa, Artificial Sequence
  Description of Artificial Sequence: Synthetic peptide
  N-term acetylated
LSWAADLWGVVTDGVASGLDKDYLKPDD

SEQ ID NO: 645 - protein, 28 aa, Artificial Sequence
  Description of Artificial Sequence: Synthetic peptide
LSTAADVWGVVTDGVASGLDKDYLKPDD

SEQ ID NO: 646 - protein, 28 aa, Artificial Sequence
  Description of Artificial Sequence: Synthetic peptide
  N-term acetylated
LSTAADVWGVVTDGVASGLDKDYLKPDD

SEQ ID NO: 647 - protein, 28 aa, Artificial Sequence
  Description of Artificial Sequence: Synthetic peptide
LSWAADVWGVVTDGVASGLDKDYLKPDD

SEQ ID NO: 648 - protein, 28 aa, Artificial Sequence
  Description of Artificial Sequence: Synthetic peptide
  N-term acetylated
LSWAADVWGVVTDGVASGLDKDYLKPDD

SEQ ID NO: 649 - protein, 28 aa, Artificial Sequence
  Description of Artificial Sequence: Synthetic peptide
LSTAADMQAVVTDGVASGLDKDYLKPDD

SEQ ID NO: 650 - protein, 28 aa, Artificial Sequence
  Description of Artificial Sequence: Synthetic peptide
  N-term acetylated
LSTAADMQAVVTDGVASGLDKDYLKPDD

SEQ ID NO: 651 - protein, 28 aa, Artificial Sequence
  Description of Artificial Sequence: Synthetic peptide
LSWAADMQAVVTDGVASGLDKDYLKPDD

SEQ ID NO: 652 - protein, 28 aa, Artificial Sequence
  Description of Artificial Sequence: Synthetic peptide
  N-term acetylated
LSWAADMQAVVTDGVASGLDKDYLKPDD

SEQ ID NO: 653 - protein, 28 aa, Artificial Sequence
  Description of Artificial Sequence: Synthetic peptide
LSTAADLQAVVTDGVASGLDKDYLKPDD

SEQ ID NO: 654 - protein, 28 aa, Artificial Sequence
  Description of Artificial Sequence: Synthetic peptide
  N-term acetylated
LSTAADLQAVVTDGVASGLDKDYLKPDD

SEQ ID NO: 655 - protein, 28 aa, Artificial Sequence
  Description of Artificial Sequence: Synthetic peptide
LSWAADLQAVVTDGVASGLDKDYLKPDD

SEQ ID NO: 656 - protein, 28 aa, Artificial Sequence
  Description of Artificial Sequence: Synthetic peptide
  N-term acetylated
LSWAADLQAVVTDGVASGLDKDYLKPDD

SEQ ID NO: 657 - protein, 28 aa, Artificial Sequence
  Description of Artificial Sequence: Synthetic peptide
LSTAADVQAVVTDGVASGLDKDYLKPDD

SEQ ID NO: 658 - protein, 28 aa, Artificial Sequence
  Description of Artificial Sequence: Synthetic peptide
  N-term acetylated
LSTAADVQAVVTDGVASGLDKDYLKPDD

SEQ ID NO: 659 - protein, 28 aa, Artificial Sequence
  Description of Artificial Sequence: Synthetic peptide
LSWAADVQAVVTDGVASGLDKDYLKPDD

SEQ ID NO: 660 - protein, 28 aa, Artificial Sequence
  Description of Artificial Sequence: Synthetic peptide
  N-term acetylated
LSWAADVQAVVTDGVASGLDKDYLKPDD

SEQ ID NO: 661 - protein, 28 aa, Artificial Sequence
  Description of Artificial Sequence: Synthetic peptide
LSTAADMWAVVTDGVASGLDKDYLKPDD

SEQ ID NO: 662 - protein, 28 aa, Artificial Sequence
  Description of Artificial Sequence: Synthetic peptide
  N-term acetylated
LSTAADMWAVVTDGVASGLDKDYLKPDD

SEQ ID NO: 663 - protein, 28 aa, Artificial Sequence
  Description of Artificial Sequence: Synthetic peptide
LSWAADMWAVVTDGVASGLDKDYLKPDD

SEQ ID NO: 664 - protein, 28 aa, Artificial Sequence
  Description of Artificial Sequence: Synthetic peptide
  N-term acetylated
LSWAADMWAVVTDGVASGLDKDYLKPDD

SEQ ID NO: 665 - protein, 28 aa, Artificial Sequence
  Description of Artificial Sequence: Synthetic peptide
LSTAADLWAVVTDGVASGLDKDYLKPDD

SEQ ID NO: 666 - protein, 28 aa, Artificial Sequence
  Description of Artificial Sequence: Synthetic peptide
  N-term acetylated
LSTAADLWAVVTDGVASGLDKDYLKPDD

SEQ ID NO: 667 - protein, 28 aa, Artificial Sequence
  Description of Artificial Sequence: Synthetic peptide
LSWAADLWAVVTDGVASGLDKDYLKPDD

SEQ ID NO: 668 - protein, 28 aa, Artificial Sequence
  Description of Artificial Sequence: Synthetic peptide
  N-term acetylated
LSWAADLWAVVTDGVASGLDKDYLKPDD

SEQ ID NO: 669 - protein, 28 aa, Artificial Sequence
  Description of Artificial Sequence: Synthetic peptide
LSTAADVWAVVTDGVASGLDKDYLKPDD

SEQ ID NO: 670 - protein, 28 aa, Artificial Sequence
  Description of Artificial Sequence: Synthetic peptide
  N-term acetylated
LSTAADVWAVVTDGVASGLDKDYLKPDD

SEQ ID NO: 671 - protein, 28 aa, Artificial Sequence
  Description of Artificial Sequence: Synthetic peptide
LSWAADVWAVVTDGVASGLDKDYLKPDD

SEQ ID NO: 672 - protein, 28 aa, Artificial Sequence
  Description of Artificial Sequence: Synthetic peptide
  N-term acetylated
LSWAADVWAVVTDGVASGLDKDYLKPDD

SEQ ID NO: 673 - protein, 28 aa, Artificial Sequence
  Description of Artificial Sequence: Synthetic peptide
LSTAADMQGVVWDGVASGLDKDYLKPDD

SEQ ID NO: 674 - protein, 28 aa, Artificial Sequence
  Description of Artificial Sequence: Synthetic peptide
  N-term acetylated
LSTAADMQGVVWDGVASGLDKDYLKPDD

SEQ ID NO: 675 - protein, 28 aa, Artificial Sequence
  Description of Artificial Sequence: Synthetic peptide
LSWAADMQGVVWDGVASGLDKDYLKPDD

SEQ ID NO: 676 - protein, 28 aa, Artificial Sequence
  Description of Artificial Sequence: Synthetic peptide
  N-term acetylated
LSWAADMQGVVWDGVASGLDKDYLKPDD

SEQ ID NO: 677 - protein, 28 aa, Artificial Sequence
  Description of Artificial Sequence: Synthetic peptide
LSTAADLQGVVWDGVASGLDKDYLKPDD

SEQ ID NO: 678 - protein, 28 aa, Artificial Sequence
  Description of Artificial Sequence: Synthetic peptide
  N-term acetylated
LSTAADLQGVVWDGVASGLDKDYLKPDD

SEQ ID NO: 679 - protein, 28 aa, Artificial Sequence
  Description of Artificial Sequence: Synthetic peptide
LSWAADLQGVVWDGVASGLDKDYLKPDD

SEQ ID NO: 680 - protein, 28 aa, Artificial Sequence
  Description of Artificial Sequence: Synthetic peptide
  N-term acetylated
LSWAADLQGVVWDGVASGLDKDYLKPDD

SEQ ID NO: 681 - protein, 28 aa, Artificial Sequence
  Description of Artificial Sequence: Synthetic peptide
LSTAADVQGVVWDGVASGLDKDYLKPDD

SEQ ID NO: 682 - protein, 28 aa, Artificial Sequence
  Description of Artificial Sequence: Synthetic peptide
  N-term acetylated
LSTAADVQGVVWDGVASGLDKDYLKPDD

SEQ ID NO: 683 - protein, 28 aa, Artificial Sequence
  Description of Artificial Sequence: Synthetic peptide
LSWAADVQGVVWDGVASGLDKDYLKPDD

SEQ ID NO: 684 - protein, 28 aa, Artificial Sequence
  Description of Artificial Sequence: Synthetic peptide
  N-term acetylated
LSWAADVQGVVWDGVASGLDKDYLKPDD

SEQ ID NO: 685 - protein, 28 aa, Artificial Sequence
  Description of Artificial Sequence: Synthetic peptide
LSTAADMWGVVWDGVASGLDKDYLKPDD

SEQ ID NO: 686 - protein, 28 aa, Artificial Sequence
  Description of Artificial Sequence: Synthetic peptide
  N-term acetylated
LSTAADMWGVVWDGVASGLDKDYLKPDD

SEQ ID NO: 687 - protein, 28 aa, Artificial Sequence
  Description of Artificial Sequence: Synthetic peptide
LSWAADMWGVVWDGVASGLDKDYLKPDD

SEQ ID NO: 688 - protein, 28 aa, Artificial Sequence
  Description of Artificial Sequence: Synthetic peptide
  N-term acetylated
LSWAADMWGVVWDGVASGLDKDYLKPDD

SEQ ID NO: 689 - protein, 28 aa, Artificial Sequence
  Description of Artificial Sequence: Synthetic peptide
LSTAADLWGVVWDGVASGLDKDYLKPDD

SEQ ID NO: 690 - protein, 28 aa, Artificial Sequence
  Description of Artificial Sequence: Synthetic peptide
  N-term acetylated
LSTAADLWGVVWDGVASGLDKDYLKPDD

SEQ ID NO: 691 - protein, 28 aa, Artificial Sequence
  Description of Artificial Sequence: Synthetic peptide
LSWAADLWGVVWDGVASGLDKDYLKPDD

SEQ ID NO: 692 - protein, 28 aa, Artificial Sequence
  Description of Artificial Sequence: Synthetic peptide
  N-term acetylated
LSWAADLWGVVWDGVASGLDKDYLKPDD

SEQ ID NO: 693 - protein, 28 aa, Artificial Sequence
  Description of Artificial Sequence: Synthetic peptide
LSTAADVWGVVWDGVASGLDKDYLKPDD

SEQ ID NO: 694 - protein, 28 aa, Artificial Sequence
  Description of Artificial Sequence: Synthetic peptide
  N-term acetylated
LSTAADVWGVVWDGVASGLDKDYLKPDD

SEQ ID NO: 695 - protein, 28 aa, Artificial Sequence
  Description of Artificial Sequence: Synthetic peptide
LSWAADVWGVVWDGVASGLDKDYLKPDD

SEQ ID NO: 696 - protein, 28 aa, Artificial Sequence
  Description of Artificial Sequence: Synthetic peptide
  N-term acetylated
LSWAADVWGVVWDGVASGLDKDYLKPDD

SEQ ID NO: 697 - protein, 28 aa, Artificial Sequence
  Description of Artificial Sequence: Synthetic peptide
LSTAADMQAVVWDGVASGLDKDYLKPDD

SEQ ID NO: 698 - protein, 28 aa, Artificial Sequence
  Description of Artificial Sequence: Synthetic peptide
  N-term acetylated
LSTAADMQAVVWDGVASGLDKDYLKPDD

SEQ ID NO: 699 - protein, 28 aa, Artificial Sequence
  Description of Artificial Sequence: Synthetic peptide
LSWAADMQAVVWDGVASGLDKDYLKPDD

SEQ ID NO: 700 - protein, 28 aa, Artificial Sequence
  Description of Artificial Sequence: Synthetic peptide
  N-term acetylated
LSWAADMQAVVWDGVASGLDKDYLKPDD

SEQ ID NO: 701 - protein, 28 aa, Artificial Sequence
  Description of Artificial Sequence: Synthetic peptide
LSTAADLQAVVWDGVASGLDKDYLKPDD

SEQ ID NO: 702 - protein, 28 aa, Artificial Sequence
  Description of Artificial Sequence: Synthetic peptide
  N-term acetylated
LSTAADLQAVVWDGVASGLDKDYLKPDD

SEQ ID NO: 703 - protein, 28 aa, Artificial Sequence
  Description of Artificial Sequence: Synthetic peptide
LSWAADLQAVVWDGVASGLDKDYLKPDD

SEQ ID NO: 704 - protein, 28 aa, Artificial Sequence
  Description of Artificial Sequence: Synthetic peptide
  N-term acetylated
LSWAADLQAVVWDGVASGLDKDYLKPDD

SEQ ID NO: 705 - protein, 28 aa, Artificial Sequence
  Description of Artificial Sequence: Synthetic peptide
LSTAADVQAVVWDGVASGLDKDYLKPDD

SEQ ID NO: 706 - protein, 28 aa, Artificial Sequence
  Description of Artificial Sequence: Synthetic peptide
  N-term acetylated
LSTAADVQAVVWDGVASGLDKDYLKPDD

SEQ ID NO: 707 - protein, 28 aa, Artificial Sequence
  Description of Artificial Sequence: Synthetic peptide
LSWAADVQAVVWDGVASGLDKDYLKPDD

SEQ ID NO: 708 - protein, 28 aa, Artificial Sequence
  Description of Artificial Sequence: Synthetic peptide
  N-term acetylated
LSWAADVQAVVWDGVASGLDKDYLKPDD

SEQ ID NO: 709 - protein, 28 aa, Artificial Sequence
  Description of Artificial Sequence: Synthetic peptide
LSTAADMWAVVWDGVASGLDKDYLKPDD

SEQ ID NO: 710 - protein, 28 aa, Artificial Sequence
  Description of Artificial Sequence: Synthetic peptide
  N-term acetylated
LSTAADMWAVVWDGVASGLDKDYLKPDD

SEQ ID NO: 711 - protein, 28 aa, Artificial Sequence
  Description of Artificial Sequence: Synthetic peptide
LSWAADMWAVVWDGVASGLDKDYLKPDD

SEQ ID NO: 712 - protein, 28 aa, Artificial Sequence
  Description of Artificial Sequence: Synthetic peptide
  N-term acetylated
LSWAADMWAVVWDGVASGLDKDYLKPDD

SEQ ID NO: 713 - protein, 28 aa, Artificial Sequence
  Description of Artificial Sequence: Synthetic peptide
LSTAADLWAVVWDGVASGLDKDYLKPDD

SEQ ID NO: 714 - protein, 28 aa, Artificial Sequence
  Description of Artificial Sequence: Synthetic peptide
  N-term acetylated
LSTAADLWAVVWDGVASGLDKDYLKPDD

SEQ ID NO: 715 - protein, 28 aa, Artificial Sequence
  Description of Artificial Sequence: Synthetic peptide
LSWAADLWAVVWDGVASGLDKDYLKPDD

SEQ ID NO: 716 - protein, 28 aa, Artificial Sequence
  Description of Artificial Sequence: Synthetic peptide
  N-term acetylated
LSWAADLWAVVWDGVASGLDKDYLKPDD

SEQ ID NO: 717 - protein, 28 aa, Artificial Sequence
  Description of Artificial Sequence: Synthetic peptide
LSTAADVWAVVWDGVASGLDKDYLKPDD

SEQ ID NO: 718 - protein, 28 aa, Artificial Sequence
  Description of Artificial Sequence: Synthetic peptide
  N-term acetylated
LSTAADVWAVVWDGVASGLDKDYLKPDD

SEQ ID NO: 719 - protein, 28 aa, Artificial Sequence
  Description of Artificial Sequence: Synthetic peptide
LSWAADVWAVVWDGVASGLDKDYLKPDD

SEQ ID NO: 720 - protein, 28 aa, Artificial Sequence
  Description of Artificial Sequence: Synthetic peptide
  N-term acetylated
LSWAADVWAVVWDGVASGLDKDYLKPDD

SEQ ID NO: 721 - protein, 28 aa, Artificial Sequence
  Description of Artificial Sequence: Synthetic peptide
LSTAADMQGVVTDTVASGLDKDYLKPDD

SEQ ID NO: 722 - protein, 28 aa, Artificial Sequence
  Description of Artificial Sequence: Synthetic peptide
  N-term acetylated
LSTAADMQGVVTDTVASGLDKDYLKPDD

SEQ ID NO: 723 - protein, 28 aa, Artificial Sequence
  Description of Artificial Sequence: Synthetic peptide
LSWAADMQGVVTDTVASGLDKDYLKPDD

SEQ ID NO: 724 - protein, 28 aa, Artificial Sequence
  Description of Artificial Sequence: Synthetic peptide
  N-term acetylated
LSWAADMQGVVTDTVASGLDKDYLKPDD

SEQ ID NO: 725 - protein, 28 aa, Artificial Sequence
  Description of Artificial Sequence: Synthetic peptide
LSTAADLQGVVTDTVASGLDKDYLKPDD

SEQ ID NO: 726 - protein, 28 aa, Artificial Sequence
  Description of Artificial Sequence: Synthetic peptide
  N-term acetylated
LSTAADLQGVVTDTVASGLDKDYLKPDD

SEQ ID NO: 727 - protein, 28 aa, Artificial Sequence
  Description of Artificial Sequence: Synthetic peptide
LSWAADLQGVVTDTVASGLDKDYLKPDD

SEQ ID NO: 728 - protein, 28 aa, Artificial Sequence
  Description of Artificial Sequence: Synthetic peptide
  N-term acetylated
LSWAADLQGVVTDTVASGLDKDYLKPDD

SEQ ID NO: 729 - protein, 28 aa, Artificial Sequence
  Description of Artificial Sequence: Synthetic peptide
LSTAADVQGVVTDTVASGLDKDYLKPDD

SEQ ID NO: 730 - protein, 28 aa, Artificial Sequence
  Description of Artificial Sequence: Synthetic peptide
  N-term acetylated
LSTAADVQGVVTDTVASGLDKDYLKPDD

SEQ ID NO: 731 - protein, 28 aa, Artificial Sequence
  Description of Artificial Sequence: Synthetic peptide
LSWAADVQGVVTDTVASGLDKDYLKPDD

SEQ ID NO: 732 - protein, 28 aa, Artificial Sequence
  Description of Artificial Sequence: Synthetic peptide
  N-term acetylated
LSWAADVQGVVTDTVASGLDKDYLKPDD

SEQ ID NO: 733 - protein, 28 aa, Artificial Sequence
  Description of Artificial Sequence: Synthetic peptide
LSTAADMWGVVTDTVASGLDKDYLKPDD

SEQ ID NO: 734 - protein, 28 aa, Artificial Sequence
  Description of Artificial Sequence: Synthetic peptide
  N-term acetylated
LSTAADMWGVVTDTVASGLDKDYLKPDD

SEQ ID NO: 735 - protein, 28 aa, Artificial Sequence
  Description of Artificial Sequence: Synthetic peptide
LSWAADMWGVVTDTVASGLDKDYLKPDD

SEQ ID NO: 736 - protein, 28 aa, Artificial Sequence
  Description of Artificial Sequence: Synthetic peptide
  N-term acetylated
LSWAADMWGVVTDTVASGLDKDYLKPDD

SEQ ID NO: 737 - protein, 28 aa, Artificial Sequence
  Description of Artificial Sequence: Synthetic peptide
LSTAADLWGVVTDTVASGLDKDYLKPDD

SEQ ID NO: 738 - protein, 28 aa, Artificial Sequence
  Description of Artificial Sequence: Synthetic peptide
  N-term acetylated
LSTAADLWGVVTDTVASGLDKDYLKPDD

SEQ ID NO: 739 - protein, 28 aa, Artificial Sequence
  Description of Artificial Sequence: Synthetic peptide
LSWAADLWGVVTDTVASGLDKDYLKPDD

SEQ ID NO: 740 - protein, 28 aa, Artificial Sequence
  Description of Artificial Sequence: Synthetic peptide
  N-term acetylated
LSWAADLWGVVTDTVASGLDKDYLKPDD

SEQ ID NO: 741 - protein, 28 aa, Artificial Sequence
  Description of Artificial Sequence: Synthetic peptide
LSTAADVWGVVTDTVASGLDKDYLKPDD

SEQ ID NO: 742 - protein, 28 aa, Artificial Sequence
  Description of Artificial Sequence: Synthetic peptide
  N-term acetylated
LSTAADVWGVVTDTVASGLDKDYLKPDD

SEQ ID NO: 743 - protein, 28 aa, Artificial Sequence
  Description of Artificial Sequence: Synthetic peptide
LSWAADVWGVVTDTVASGLDKDYLKPDD

SEQ ID NO: 744 - protein, 28 aa, Artificial Sequence
  Description of Artificial Sequence: Synthetic peptide
  N-term acetylated
LSWAADVWGVVTDTVASGLDKDYLKPDD

SEQ ID NO: 745 - protein, 28 aa, Artificial Sequence
  Description of Artificial Sequence: Synthetic peptide
LSTAADMQAVVTDTVASGLDKDYLKPDD

SEQ ID NO: 746 - protein, 28 aa, Artificial Sequence
  Description of Artificial Sequence: Synthetic peptide
  N-term acetylated
LSTAADMQAVVTDTVASGLDKDYLKPDD

SEQ ID NO: 747 - protein, 28 aa, Artificial Sequence
  Description of Artificial Sequence: Synthetic peptide
LSWAADMQAVVTDTVASGLDKDYLKPDD

SEQ ID NO: 748 - protein, 28 aa, Artificial Sequence
  Description of Artificial Sequence: Synthetic peptide
  N-term acetylated
LSWAADMQAVVTDTVASGLDKDYLKPDD

SEQ ID NO: 749 - protein, 28 aa, Artificial Sequence
  Description of Artificial Sequence: Synthetic peptide
LSTAADLQAVVTDTVASGLDKDYLKPDD

SEQ ID NO: 750 - protein, 28 aa, Artificial Sequence
  Description of Artificial Sequence: Synthetic peptide
  N-term acetylated
LSTAADLQAVVTDTVASGLDKDYLKPDD

SEQ ID NO: 751 - protein, 28 aa, Artificial Sequence
  Description of Artificial Sequence: Synthetic peptide
LSWAADLQAVVTDTVASGLDKDYLKPDD

SEQ ID NO: 752 - protein, 28 aa, Artificial Sequence
  Description of Artificial Sequence: Synthetic peptide
  N-term acetylated
LSWAADLQAVVTDTVASGLDKDYLKPDD

SEQ ID NO: 753 - protein, 28 aa, Artificial Sequence
  Description of Artificial Sequence: Synthetic peptide
LSTAADVQAVVTDTVASGLDKDYLKPDD

SEQ ID NO: 754 - protein, 28 aa, Artificial Sequence
  Description of Artificial Sequence: Synthetic peptide
  N-term acetylated
LSTAADVQAVVTDTVASGLDKDYLKPDD

SEQ ID NO: 755 - protein, 28 aa, Artificial Sequence
  Description of Artificial Sequence: Synthetic peptide
LSWAADVQAVVTDTVASGLDKDYLKPDD

SEQ ID NO: 756 - protein, 28 aa, Artificial Sequence
  Description of Artificial Sequence: Synthetic peptide
  N-term acetylated
LSWAADVQAVVTDTVASGLDKDYLKPDD

SEQ ID NO: 757 - protein, 28 aa, Artificial Sequence
  Description of Artificial Sequence: Synthetic peptide
LSTAADMWAVVTDTVASGLDKDYLKPDD

SEQ ID NO: 758 - protein, 28 aa, Artificial Sequence
  Description of Artificial Sequence: Synthetic peptide
  N-term acetylated
LSTAADMWAVVTDTVASGLDKDYLKPDD

SEQ ID NO: 759 - protein, 28 aa, Artificial Sequence
  Description of Artificial Sequence: Synthetic peptide
LSWAADMWAVVTDTVASGLDKDYLKPDD

SEQ ID NO: 760 - protein, 28 aa, Artificial Sequence
  Description of Artificial Sequence: Synthetic peptide
  N-term acetylated
LSWAADMWAVVTDTVASGLDKDYLKPDD

SEQ ID NO: 761 - protein, 28 aa, Artificial Sequence
  Description of Artificial Sequence: Synthetic peptide
LSTAADLWAVVTDTVASGLDKDYLKPDD

SEQ ID NO: 762 - protein, 28 aa, Artificial Sequence
  Description of Artificial Sequence: Synthetic peptide
  N-term acetylated
LSTAADLWAVVTDTVASGLDKDYLKPDD

SEQ ID NO: 763 - protein, 28 aa, Artificial Sequence
  Description of Artificial Sequence: Synthetic peptide
LSWAADLWAVVTDTVASGLDKDYLKPDD

SEQ ID NO: 764 - protein, 28 aa, Artificial Sequence
  Description of Artificial Sequence: Synthetic peptide
  N-term acetylated
LSWAADLWAVVTDTVASGLDKDYLKPDD

SEQ ID NO: 765 - protein, 28 aa, Artificial Sequence
  Description of Artificial Sequence: Synthetic peptide
LSTAADVWAVVTDTVASGLDKDYLKPDD

SEQ ID NO: 766 - protein, 28 aa, Artificial Sequence
  Description of Artificial Sequence: Synthetic peptide
  N-term acetylated
LSTAADVWAVVTDTVASGLDKDYLKPDD

SEQ ID NO: 767 - protein, 28 aa, Artificial Sequence
  Description of Artificial Sequence: Synthetic peptide
LSWAADVWAVVTDTVASGLDKDYLKPDD

SEQ ID NO: 768 - protein, 28 aa, Artificial Sequence
  Description of Artificial Sequence: Synthetic peptide
  N-term acetylated
LSWAADVWAVVTDTVASGLDKDYLKPDD

SEQ ID NO: 769 - protein, 28 aa, Artificial Sequence
  Description of Artificial Sequence: Synthetic peptide
LSTAADMQGVVWDTVASGLDKDYLKPDD

SEQ ID NO: 770 - protein, 28 aa, Artificial Sequence
  Description of Artificial Sequence: Synthetic peptide
  N-term acetylated
LSTAADMQGVVWDTVASGLDKDYLKPDD

SEQ ID NO: 771 - protein, 28 aa, Artificial Sequence
  Description of Artificial Sequence: Synthetic peptide
LSWAADMQGVVWDTVASGLDKDYLKPDD

SEQ ID NO: 772 - protein, 28 aa, Artificial Sequence
  Description of Artificial Sequence: Synthetic peptide
  N-term acetylated
LSWAADMQGVVWDTVASGLDKDYLKPDD

SEQ ID NO: 773 - protein, 28 aa, Artificial Sequence
  Description of Artificial Sequence: Synthetic peptide
LSTAADLQGVVWDTVASGLDKDYLKPDD

SEQ ID NO: 774 - protein, 28 aa, Artificial Sequence
  Description of Artificial Sequence: Synthetic peptide
  N-term acetylated
LSTAADLQGVVWDTVASGLDKDYLKPDD

SEQ ID NO: 775 - protein, 28 aa, Artificial Sequence
  Description of Artificial Sequence: Synthetic peptide
LSWAADLQGVVWDTVASGLDKDYLKPDD

SEQ ID NO: 776 - protein, 28 aa, Artificial Sequence
  Description of Artificial Sequence: Synthetic peptide
  N-term acetylated
LSWAADLQGVVWDTVASGLDKDYLKPDD

SEQ ID NO: 777 - protein, 28 aa, Artificial Sequence
  Description of Artificial Sequence: Synthetic peptide
LSTAADVQGVVWDTVASGLDKDYLKPDD

SEQ ID NO: 778 - protein, 28 aa, Artificial Sequence
  Description of Artificial Sequence: Synthetic peptide
  N-term acetylated
LSTAADVQGVVWDTVASGLDKDYLKPDD

SEQ ID NO: 779 - protein, 28 aa, Artificial Sequence
  Description of Artificial Sequence: Synthetic peptide
LSWAADVQGVVWDTVASGLDKDYLKPDD

SEQ ID NO: 780 - protein, 28 aa, Artificial Sequence
  Description of Artificial Sequence: Synthetic peptide
  N-term acetylated
LSWAADVQGVVWDTVASGLDKDYLKPDD

SEQ ID NO: 781 - protein, 28 aa, Artificial Sequence
  Description of Artificial Sequence: Synthetic peptide
LSTAADMWGVVWDTVASGLDKDYLKPDD

SEQ ID NO: 782 - protein, 28 aa, Artificial Sequence
  Description of Artificial Sequence: Synthetic peptide
  N-term acetylated
LSTAADMWGVVWDTVASGLDKDYLKPDD

SEQ ID NO: 783 - protein, 28 aa, Artificial Sequence
  Description of Artificial Sequence: Synthetic peptide
LSWAADMWGVVWDTVASGLDKDYLKPDD

SEQ ID NO: 784 - protein, 28 aa, Artificial Sequence
  Description of Artificial Sequence: Synthetic peptide
  N-term acetylated
LSWAADMWGVVWDTVASGLDKDYLKPDD

SEQ ID NO: 785 - protein, 28 aa, Artificial Sequence
  Description of Artificial Sequence: Synthetic peptide
LSTAADLWGVVWDTVASGLDKDYLKPDD

SEQ ID NO: 786 - protein, 28 aa, Artificial Sequence
  Description of Artificial Sequence: Synthetic peptide
  N-term acetylated
LSTAADLWGVVWDTVASGLDKDYLKPDD

SEQ ID NO: 787 - protein, 28 aa, Artificial Sequence
  Description of Artificial Sequence: Synthetic peptide
LSWAADLWGVVWDTVASGLDKDYLKPDD

SEQ ID NO: 788 - protein, 28 aa, Artificial Sequence
  Description of Artificial Sequence: Synthetic peptide
  N-term acetylated
LSWAADLWGVVWDTVASGLDKDYLKPDD

SEQ ID NO: 789 - protein, 28 aa, Artificial Sequence
  Description of Artificial Sequence: Synthetic peptide
LSTAADVWGVVWDTVASGLDKDYLKPDD

SEQ ID NO: 790 - protein, 28 aa, Artificial Sequence
  Description of Artificial Sequence: Synthetic peptide
  N-term acetylated
LSTAADVWGVVWDTVASGLDKDYLKPDD

SEQ ID NO: 791 - protein, 28 aa, Artificial Sequence
  Description of Artificial Sequence: Synthetic peptide
LSWAADVWGVVWDTVASGLDKDYLKPDD

SEQ ID NO: 792 - protein, 28 aa, Artificial Sequence
  Description of Artificial Sequence: Synthetic peptide
  N-term acetylated
LSWAADVWGVVWDTVASGLDKDYLKPDD

SEQ ID NO: 793 - protein, 28 aa, Artificial Sequence
  Description of Artificial Sequence: Synthetic peptide
LSTAADMQAVVWDTVASGLDKDYLKPDD

SEQ ID NO: 794 - protein, 28 aa, Artificial Sequence
  Description of Artificial Sequence: Synthetic peptide
  N-term acetylated
LSTAADMQAVVWDTVASGLDKDYLKPDD

SEQ ID NO: 795 - protein, 28 aa, Artificial Sequence
  Description of Artificial Sequence: Synthetic peptide
LSWAADMQAVVWDTVASGLDKDYLKPDD

SEQ ID NO: 796 - protein, 28 aa, Artificial Sequence
  Description of Artificial Sequence: Synthetic peptide
  N-term acetylated
LSWAADMQAVVWDTVASGLDKDYLKPDD

SEQ ID NO: 797 - protein, 28 aa, Artificial Sequence
  Description of Artificial Sequence: Synthetic peptide
LSTAADLQAVVWDTVASGLDKDYLKPDD

SEQ ID NO: 798 - protein, 28 aa, Artificial Sequence
  Description of Artificial Sequence: Synthetic peptide
  N-term acetylated
LSTAADLQAVVWDTVASGLDKDYLKPDD

SEQ ID NO: 799 - protein, 28 aa, Artificial Sequence
  Description of Artificial Sequence: Synthetic peptide
LSWAADLQAVVWDTVASGLDKDYLKPDD

SEQ ID NO: 800 - protein, 28 aa, Artificial Sequence
  Description of Artificial Sequence: Synthetic peptide
  N-term acetylated
LSWAADLQAVVWDTVASGLDKDYLKPDD

SEQ ID NO: 801 - protein, 28 aa, Artificial Sequence
  Description of Artificial Sequence: Synthetic peptide
LSTAADVQAVVWDTVASGLDKDYLKPDD

SEQ ID NO: 802 - protein, 28 aa, Artificial Sequence
  Description of Artificial Sequence: Synthetic peptide
  N-term acetylated
LSTAADVQAVVWDTVASGLDKDYLKPDD

SEQ ID NO: 803 - protein, 28 aa, Artificial Sequence
  Description of Artificial Sequence: Synthetic peptide
LSWAADVQAVVWDTVASGLDKDYLKPDD

SEQ ID NO: 804 - protein, 28 aa, Artificial Sequence
  Description of Artificial Sequence: Synthetic peptide
  N-term acetylated
LSWAADVQAVVWDTVASGLDKDYLKPDD

SEQ ID NO: 805 - protein, 28 aa, Artificial Sequence
  Description of Artificial Sequence: Synthetic peptide
LSTAADMWAVVWDTVASGLDKDYLKPDD

SEQ ID NO: 806 - protein, 28 aa, Artificial Sequence
  Description of Artificial Sequence: Synthetic peptide
  N-term acetylated
LSTAADMWAVVWDTVASGLDKDYLKPDD

SEQ ID NO: 807 - protein, 28 aa, Artificial Sequence
  Description of Artificial Sequence: Synthetic peptide
LSWAADMWAVVWDTVASGLDKDYLKPDD

SEQ ID NO: 808 - protein, 28 aa, Artificial Sequence
  Description of Artificial Sequence: Synthetic peptide
  N-term acetylated
LSWAADMWAVVWDTVASGLDKDYLKPDD

SEQ ID NO: 809 - protein, 28 aa, Artificial Sequence
  Description of Artificial Sequence: Synthetic peptide
LSTAADLWAVVWDTVASGLDKDYLKPDD

SEQ ID NO: 810 - protein, 28 aa, Artificial Sequence
  Description of Artificial Sequence: Synthetic peptide
  N-term acetylated
LSTAADLWAVVWDTVASGLDKDYLKPDD

SEQ ID NO: 811 - protein, 28 aa, Artificial Sequence
  Description of Artificial Sequence: Synthetic peptide
LSWAADLWAVVWDTVASGLDKDYLKPDD

SEQ ID NO: 812 - protein, 28 aa, Artificial Sequence
  Description of Artificial Sequence: Synthetic peptide
  N-term acetylated
LSWAADLWAVVWDTVASGLDKDYLKPDD

SEQ ID NO: 813 - protein, 28 aa, Artificial Sequence
  Description of Artificial Sequence: Synthetic peptide
LSTAADVWAVVWDTVASGLDKDYLKPDD

SEQ ID NO: 814 - protein, 28 aa, Artificial Sequence
  Description of Artificial Sequence: Synthetic peptide
  N-term acetylated
LSTAADVWAVVWDTVASGLDKDYLKPDD

SEQ ID NO: 815 - protein, 28 aa, Artificial Sequence
  Description of Artificial Sequence: Synthetic peptide
LSWAADVWAVVWDTVASGLDKDYLKPDD

SEQ ID NO: 816 - protein, 28 aa, Artificial Sequence
  Description of Artificial Sequence: Synthetic peptide
  N-term acetylated
LSWAADVWAVVWDTVASGLDKDYLKPDD

SEQ ID NO: 817 - protein, 28 aa, Artificial Sequence
  Description of Artificial Sequence: Synthetic peptide
LSTAADMQGVVTDWVASGLDKDYLKPDD

SEQ ID NO: 818 - protein, 28 aa, Artificial Sequence
  Description of Artificial Sequence: Synthetic peptide
  N-term acetylated
LSTAADMQGVVTDWVASGLDKDYLKPDD

SEQ ID NO: 819 - protein, 28 aa, Artificial Sequence
  Description of Artificial Sequence: Synthetic peptide
LSWAADMQGVVTDWVASGLDKDYLKPDD

SEQ ID NO: 820 - protein, 28 aa, Artificial Sequence
  Description of Artificial Sequence: Synthetic peptide
  N-term acetylated
LSWAADMQGVVTDWVASGLDKDYLKPDD

SEQ ID NO: 821 - protein, 28 aa, Artificial Sequence
  Description of Artificial Sequence: Synthetic peptide
LSTAADLQGVVTDWVASGLDKDYLKPDD

SEQ ID NO: 822 - protein, 28 aa, Artificial Sequence
  Description of Artificial Sequence: Synthetic peptide
  N-term acetylated
LSTAADLQGVVTDWVASGLDKDYLKPDD

SEQ ID NO: 823 - protein, 28 aa, Artificial Sequence
  Description of Artificial Sequence: Synthetic peptide
LSWAADLQGVVTDWVASGLDKDYLKPDD

SEQ ID NO: 824 - protein, 28 aa, Artificial Sequence
  Description of Artificial Sequence: Synthetic peptide
  N-term acetylated
LSWAADLQGVVTDWVASGLDKDYLKPDD

SEQ ID NO: 825 - protein, 28 aa, Artificial Sequence
  Description of Artificial Sequence: Synthetic peptide
LSTAADVQGVVTDWVASGLDKDYLKPDD

SEQ ID NO: 826 - protein, 28 aa, Artificial Sequence
  Description of Artificial Sequence: Synthetic peptide
  N-term acetylated
LSTAADVQGVVTDWVASGLDKDYLKPDD

SEQ ID NO: 827 - protein, 28 aa, Artificial Sequence
  Description of Artificial Sequence: Synthetic peptide
LSWAADVQGVVTDWVASGLDKDYLKPDD

SEQ ID NO: 828 - protein, 28 aa, Artificial Sequence
  Description of Artificial Sequence: Synthetic peptide
  N-term acetylated
LSWAADVQGVVTDWVASGLDKDYLKPDD

SEQ ID NO: 829 - protein, 28 aa, Artificial Sequence
  Description of Artificial Sequence: Synthetic peptide
LSTAADMWGVVTDWVASGLDKDYLKPDD

SEQ ID NO: 830 - protein, 28 aa, Artificial Sequence
  Description of Artificial Sequence: Synthetic peptide
  N-term acetylated
LSTAADMWGVVTDWVASGLDKDYLKPDD

SEQ ID NO: 831 - protein, 28 aa, Artificial Sequence
  Description of Artificial Sequence: Synthetic peptide
LSWAADMWGVVTDWVASGLDKDYLKPDD

SEQ ID NO: 832 - protein, 28 aa, Artificial Sequence
  Description of Artificial Sequence: Synthetic peptide
  N-term acetylated
LSWAADMWGVVTDWVASGLDKDYLKPDD

SEQ ID NO: 833 - protein, 28 aa, Artificial Sequence
  Description of Artificial Sequence: Synthetic peptide
LSTAADLWGVVTDWVASGLDKDYLKPDD

SEQ ID NO: 834 - protein, 28 aa, Artificial Sequence
  Description of Artificial Sequence: Synthetic peptide
  N-term acetylated
LSTAADLWGVVTDWVASGLDKDYLKPDD

SEQ ID NO: 835 - protein, 28 aa, Artificial Sequence
  Description of Artificial Sequence: Synthetic peptide
LSWAADLWGVVTDWVASGLDKDYLKPDD

SEQ ID NO: 836 - protein, 28 aa, Artificial Sequence
  Description of Artificial Sequence: Synthetic peptide
  N-term acetylated
LSWAADLWGVVTDWVASGLDKDYLKPDD

SEQ ID NO: 837 - protein, 28 aa, Artificial Sequence
  Description of Artificial Sequence: Synthetic peptide
LSTAADVWGVVTDWVASGLDKDYLKPDD

SEQ ID NO: 838 - protein, 28 aa, Artificial Sequence
  Description of Artificial Sequence: Synthetic peptide
  N-term acetylated
LSTAADVWGVVTDWVASGLDKDYLKPDD

SEQ ID NO: 839 - protein, 28 aa, Artificial Sequence
  Description of Artificial Sequence: Synthetic peptide
LSWAADVWGVVTDWVASGLDKDYLKPDD

SEQ ID NO: 840 - protein, 28 aa, Artificial Sequence
  Description of Artificial Sequence: Synthetic peptide
  N-term acetylated
LSWAADVWGVVTDWVASGLDKDYLKPDD

SEQ ID NO: 841 - protein, 28 aa, Artificial Sequence
  Description of Artificial Sequence: Synthetic peptide
LSTAADMQAVVTDWVASGLDKDYLKPDD

SEQ ID NO: 842 - protein, 28 aa, Artificial Sequence
  Description of Artificial Sequence: Synthetic peptide
  N-term acetylated
LSTAADMQAVVTDWVASGLDKDYLKPDD

SEQ ID NO: 843 - protein, 28 aa, Artificial Sequence
  Description of Artificial Sequence: Synthetic peptide
LSWAADMQAVVTDWVASGLDKDYLKPDD

SEQ ID NO: 844 - protein, 28 aa, Artificial Sequence
  Description of Artificial Sequence: Synthetic peptide
  N-term acetylated
LSWAADMQAVVTDWVASGLDKDYLKPDD

SEQ ID NO: 845 - protein, 28 aa, Artificial Sequence
  Description of Artificial Sequence: Synthetic peptide
LSTAADLQAVVTDWVASGLDKDYLKPDD

SEQ ID NO: 846 - protein, 28 aa, Artificial Sequence
  Description of Artificial Sequence: Synthetic peptide
  N-term acetylated
LSTAADLQAVVTDWVASGLDKDYLKPDD

SEQ ID NO: 847 - protein, 28 aa, Artificial Sequence
  Description of Artificial Sequence: Synthetic peptide
LSWAADLQAVVTDWVASGLDKDYLKPDD

SEQ ID NO: 848 - protein, 28 aa, Artificial Sequence
  Description of Artificial Sequence: Synthetic peptide
  N-term acetylated
LSWAADLQAVVTDWVASGLDKDYLKPDD

SEQ ID NO: 849 - protein, 28 aa, Artificial Sequence
  Description of Artificial Sequence: Synthetic peptide
LSTAADVQAVVTDWVASGLDKDYLKPDD

SEQ ID NO: 850 - protein, 28 aa, Artificial Sequence
  Description of Artificial Sequence: Synthetic peptide
  N-term acetylated
LSTAADVQAVVTDWVASGLDKDYLKPDD

SEQ ID NO: 851 - protein, 28 aa, Artificial Sequence
  Description of Artificial Sequence: Synthetic peptide
LSWAADVQAVVTDWVASGLDKDYLKPDD

SEQ ID NO: 852 - protein, 28 aa, Artificial Sequence
  Description of Artificial Sequence: Synthetic peptide
  N-term acetylated
LSWAADVQAVVTDWVASGLDKDYLKPDD

SEQ ID NO: 853 - protein, 28 aa, Artificial Sequence
  Description of Artificial Sequence: Synthetic peptide
LSTAADMWAVVTDWVASGLDKDYLKPDD

SEQ ID NO: 854 - protein, 28 aa, Artificial Sequence
  Description of Artificial Sequence: Synthetic peptide
  N-term acetylated
LSTAADMWAVVTDWVASGLDKDYLKPDD

SEQ ID NO: 855 - protein, 28 aa, Artificial Sequence
  Description of Artificial Sequence: Synthetic peptide
LSWAADMWAVVTDWVASGLDKDYLKPDD

SEQ ID NO: 856 - protein, 28 aa, Artificial Sequence
  Description of Artificial Sequence: Synthetic peptide
  N-term acetylated
LSWAADMWAVVTDWVASGLDKDYLKPDD

SEQ ID NO: 857 - protein, 28 aa, Artificial Sequence
  Description of Artificial Sequence: Synthetic peptide
LSTAADLWAVVTDWVASGLDKDYLKPDD

SEQ ID NO: 858 - protein, 28 aa, Artificial Sequence
  Description of Artificial Sequence: Synthetic peptide
  N-term acetylated
LSTAADLWAVVTDWVASGLDKDYLKPDD

SEQ ID NO: 859 - protein, 28 aa, Artificial Sequence
  Description of Artificial Sequence: Synthetic peptide
LSWAADLWAVVTDWVASGLDKDYLKPDD

SEQ ID NO: 860 - protein, 28 aa, Artificial Sequence
  Description of Artificial Sequence: Synthetic peptide
  N-term acetylated
LSWAADLWAVVTDWVASGLDKDYLKPDD

SEQ ID NO: 861 - protein, 28 aa, Artificial Sequence
  Description of Artificial Sequence: Synthetic peptide
LSTAADVWAVVTDWVASGLDKDYLKPDD

SEQ ID NO: 862 - protein, 28 aa, Artificial Sequence
  Description of Artificial Sequence: Synthetic peptide
  N-term acetylated
LSTAADVWAVVTDWVASGLDKDYLKPDD

SEQ ID NO: 863 - protein, 28 aa, Artificial Sequence
  Description of Artificial Sequence: Synthetic peptide
LSWAADVWAVVTDWVASGLDKDYLKPDD

SEQ ID NO: 864 - protein, 28 aa, Artificial Sequence
  Description of Artificial Sequence: Synthetic peptide
  N-term acetylated
LSWAADVWAVVTDWVASGLDKDYLKPDD

SEQ ID NO: 865 - protein, 28 aa, Artificial Sequence
  Description of Artificial Sequence: Synthetic peptide
LSTAADMQGVVWDWVASGLDKDYLKPDD

SEQ ID NO: 866 - protein, 28 aa, Artificial Sequence
  Description of Artificial Sequence: Synthetic peptide
  N-term acetylated
LSTAADMQGVVWDWVASGLDKDYLKPDD

SEQ ID NO: 867 - protein, 28 aa, Artificial Sequence
  Description of Artificial Sequence: Synthetic peptide
LSWAADMQGVVWDWVASGLDKDYLKPDD

SEQ ID NO: 868 - protein, 28 aa, Artificial Sequence
  Description of Artificial Sequence: Synthetic peptide
  N-term acetylated
LSWAADMQGVVWDWVASGLDKDYLKPDD

SEQ ID NO: 869 - protein, 28 aa, Artificial Sequence
  Description of Artificial Sequence: Synthetic peptide
LSTAADLQGVVWDWVASGLDKDYLKPDD

SEQ ID NO: 870 - protein, 28 aa, Artificial Sequence
  Description of Artificial Sequence: Synthetic peptide
  N-term acetylated
LSTAADLQGVVWDWVASGLDKDYLKPDD

SEQ ID NO: 871 - protein, 28 aa, Artificial Sequence
  Description of Artificial Sequence: Synthetic peptide
LSWAADLQGVVWDWVASGLDKDYLKPDD

SEQ ID NO: 872 - protein, 28 aa, Artificial Sequence
  Description of Artificial Sequence: Synthetic peptide
  N-term acetylated
LSWAADLQGVVWDWVASGLDKDYLKPDD

SEQ ID NO: 873 - protein, 28 aa, Artificial Sequence
  Description of Artificial Sequence: Synthetic peptide
LSTAADVQGVVWDWVASGLDKDYLKPDD

SEQ ID NO: 874 - protein, 28 aa, Artificial Sequence
  Description of Artificial Sequence: Synthetic peptide
  N-term acetylated
LSTAADVQGVVWDWVASGLDKDYLKPDD

SEQ ID NO: 875 - protein, 28 aa, Artificial Sequence
  Description of Artificial Sequence: Synthetic peptide
LSWAADVQGVVWDWVASGLDKDYLKPDD

SEQ ID NO: 876 - protein, 28 aa, Artificial Sequence
  Description of Artificial Sequence: Synthetic peptide
  N-term acetylated
LSWAADVQGVVWDWVASGLDKDYLKPDD

SEQ ID NO: 877 - protein, 28 aa, Artificial Sequence
  Description of Artificial Sequence: Synthetic peptide
LSTAADMWGVVWDWVASGLDKDYLKPDD

SEQ ID NO: 878 - protein, 28 aa, Artificial Sequence
  Description of Artificial Sequence: Synthetic peptide
  N-term acetylated
LSTAADMWGVVWDWVASGLDKDYLKPDD

SEQ ID NO: 879 - protein, 28 aa, Artificial Sequence
  Description of Artificial Sequence: Synthetic peptide
LSWAADMWGVVWDWVASGLDKDYLKPDD

SEQ ID NO: 880 - protein, 28 aa, Artificial Sequence
  Description of Artificial Sequence: Synthetic peptide
  N-term acetylated
LSWAADMWGVVWDWVASGLDKDYLKPDD

SEQ ID NO: 881 - protein, 28 aa, Artificial Sequence
  Description of Artificial Sequence: Synthetic peptide
LSTAADLWGVVWDWVASGLDKDYLKPDD

SEQ ID NO: 882 - protein, 28 aa, Artificial Sequence
  Description of Artificial Sequence: Synthetic peptide
  N-term acetylated
LSTAADLWGVVWDWVASGLDKDYLKPDD

SEQ ID NO: 883 - protein, 28 aa, Artificial Sequence
  Description of Artificial Sequence: Synthetic peptide
LSWAADLWGVVWDWVASGLDKDYLKPDD

SEQ ID NO: 884 - protein, 28 aa, Artificial Sequence
  Description of Artificial Sequence: Synthetic peptide
  N-term acetylated
LSWAADLWGVVWDWVASGLDKDYLKPDD

SEQ ID NO: 885 - protein, 28 aa, Artificial Sequence
  Description of Artificial Sequence: Synthetic peptide
LSTAADVWGVVWDWVASGLDKDYLKPDD

SEQ ID NO: 886 - protein, 28 aa, Artificial Sequence
  Description of Artificial Sequence: Synthetic peptide
  N-term acetylated
LSTAADVWGVVWDWVASGLDKDYLKPDD

SEQ ID NO: 887 - protein, 28 aa, Artificial Sequence
  Description of Artificial Sequence: Synthetic peptide
LSWAADVWGVVWDWVASGLDKDYLKPDD

SEQ ID NO: 888 - protein, 28 aa, Artificial Sequence
  Description of Artificial Sequence: Synthetic peptide
  N-term acetylated
LSWAADVWGVVWDWVASGLDKDYLKPDD

SEQ ID NO: 889 - protein, 28 aa, Artificial Sequence
  Description of Artificial Sequence: Synthetic peptide
LSTAADMQAVVWDWVASGLDKDYLKPDD

SEQ ID NO: 890 - protein, 28 aa, Artificial Sequence
  Description of Artificial Sequence: Synthetic peptide
  N-term acetylated
LSTAADMQAVVWDWVASGLDKDYLKPDD

SEQ ID NO: 891 - protein, 28 aa, Artificial Sequence
  Description of Artificial Sequence: Synthetic peptide
LSWAADMQAVVWDWVASGLDKDYLKPDD

SEQ ID NO: 892 - protein, 28 aa, Artificial Sequence
  Description of Artificial Sequence: Synthetic peptide
  N-term acetylated
LSWAADMQAVVWDWVASGLDKDYLKPDD

SEQ ID NO: 893 - protein, 28 aa, Artificial Sequence
  Description of Artificial Sequence: Synthetic peptide
LSTAADLQAVVWDWVASGLDKDYLKPDD

SEQ ID NO: 894 - protein, 28 aa, Artificial Sequence
  Description of Artificial Sequence: Synthetic peptide
  N-term acetylated
LSTAADLQAVVWDWVASGLDKDYLKPDD

SEQ ID NO: 895 - protein, 28 aa, Artificial Sequence
  Description of Artificial Sequence: Synthetic peptide
LSWAADLQAVVWDWVASGLDKDYLKPDD

SEQ ID NO: 896 - protein, 28 aa, Artificial Sequence
  Description of Artificial Sequence: Synthetic peptide
  N-term acetylated
LSWAADLQAVVWDWVASGLDKDYLKPDD

SEQ ID NO: 897 - protein, 28 aa, Artificial Sequence
  Description of Artificial Sequence: Synthetic peptide
LSTAADVQAVVWDWVASGLDKDYLKPDD

SEQ ID NO: 898 - protein, 28 aa, Artificial Sequence
  Description of Artificial Sequence: Synthetic peptide
  N-term acetylated
LSTAADVQAVVWDWVASGLDKDYLKPDD

SEQ ID NO: 899 - protein, 28 aa, Artificial Sequence
  Description of Artificial Sequence: Synthetic peptide
LSWAADVQAVVWDWVASGLDKDYLKPDD

SEQ ID NO: 900 - protein, 28 aa, Artificial Sequence
  Description of Artificial Sequence: Synthetic peptide
  N-term acetylated
LSWAADVQAVVWDWVASGLDKDYLKPDD

SEQ ID NO: 901 - protein, 28 aa, Artificial Sequence
  Description of Artificial Sequence: Synthetic peptide
LSTAADMWAVVWDWVASGLDKDYLKPDD

SEQ ID NO: 902 - protein, 28 aa, Artificial Sequence
  Description of Artificial Sequence: Synthetic peptide
  N-term acetylated
LSTAADMWAVVWDWVASGLDKDYLKPDD

SEQ ID NO: 903 - protein, 28 aa, Artificial Sequence
  Description of Artificial Sequence: Synthetic peptide
LSWAADMWAVVWDWVASGLDKDYLKPDD

SEQ ID NO: 904 - protein, 28 aa, Artificial Sequence
  Description of Artificial Sequence: Synthetic peptide
  N-term acetylated
LSWAADMWAVVWDWVASGLDKDYLKPDD

SEQ ID NO: 905 - protein, 28 aa, Artificial Sequence
  Description of Artificial Sequence: Synthetic peptide
LSTAADLWAVVWDWVASGLDKDYLKPDD

SEQ ID NO: 906 - protein, 28 aa, Artificial Sequence
  Description of Artificial Sequence: Synthetic peptide
  N-term acetylated
LSTAADLWAVVWDWVASGLDKDYLKPDD

SEQ ID NO: 907 - protein, 28 aa, Artificial Sequence
  Description of Artificial Sequence: Synthetic peptide
LSWAADLWAVVWDWVASGLDKDYLKPDD

SEQ ID NO: 908 - protein, 28 aa, Artificial Sequence
  Description of Artificial Sequence: Synthetic peptide
  N-term acetylated
LSWAADLWAVVWDWVASGLDKDYLKPDD

SEQ ID NO: 909 - protein, 28 aa, Artificial Sequence
  Description of Artificial Sequence: Synthetic peptide
LSTAADVWAVVWDWVASGLDKDYLKPDD

SEQ ID NO: 910 - protein, 28 aa, Artificial Sequence
  Description of Artificial Sequence: Synthetic peptide
  N-term acetylated
LSTAADVWAVVWDWVASGLDKDYLKPDD

SEQ ID NO: 911 - protein, 28 aa, Artificial Sequence
  Description of Artificial Sequence: Synthetic peptide
LSWAADVWAVVWDWVASGLDKDYLKPDD

SEQ ID NO: 912 - protein, 28 aa, Artificial Sequence
  Description of Artificial Sequence: Synthetic peptide
  N-term acetylated
LSWAADVWAVVWDWVASGLDKDYLKPDD

SEQ ID NO: 913 - protein, 28 aa, Artificial Sequence
  Description of Artificial Sequence: Synthetic peptide
  C-term amidated
LSTAADMQGVVTDGMASGLDKDYLKPDD

SEQ ID NO: 914 - protein, 28 aa, Artificial Sequence
  Description of Artificial Sequence: Synthetic peptide
  N-term acetylated
  C-term amidated
LSTAADMQGVVTDGMASGLDKDYLKPDD

SEQ ID NO: 915 - protein, 28 aa, Artificial Sequence
  Description of Artificial Sequence: Synthetic peptide
  C-term amidated
LSWAADMQGVVTDGMASGLDKDYLKPDD

SEQ ID NO: 916 - protein, 28 aa, Artificial Sequence
  Description of Artificial Sequence: Synthetic peptide
  N-term acetylated
  C-term amidated
LSWAADMQGVVTDGMASGLDKDYLKPDD

SEQ ID NO: 917 - protein, 28 aa, Artificial Sequence
  Description of Artificial Sequence: Synthetic peptide
  C-term amidated
LSTAADLQGVVTDGMASGLDKDYLKPDD

SEQ ID NO: 918 - protein, 28 aa, Artificial Sequence
  Description of Artificial Sequence: Synthetic peptide
  N-term acetylated
  C-term amidated
LSTAADLQGVVTDGMASGLDKDYLKPDD

SEQ ID NO: 919 - protein, 28 aa, Artificial Sequence
  Description of Artificial Sequence: Synthetic peptide
  C-term amidated
LSWAADLQGVVTDGMASGLDKDYLKPDD

SEQ ID NO: 920 - protein, 28 aa, Artificial Sequence
  Description of Artificial Sequence: Synthetic peptide
  N-term acetylated
  C-term amidated
LSWAADLQGVVTDGMASGLDKDYLKPDD

SEQ ID NO: 921 - protein, 28 aa, Artificial Sequence
  Description of Artificial Sequence: Synthetic peptide
  C-term amidated
LSTAADVQGVVTDGMASGLDKDYLKPDD

SEQ ID NO: 922 - protein, 28 aa, Artificial Sequence
  Description of Artificial Sequence: Synthetic peptide
  N-term acetylated
  C-term amidated
LSTAADVQGVVTDGMASGLDKDYLKPDD

SEQ ID NO: 923 - protein, 28 aa, Artificial Sequence
  Description of Artificial Sequence: Synthetic peptide
  C-term amidated
LSWAADVQGVVTDGMASGLDKDYLKPDD

SEQ ID NO: 924 - protein, 28 aa, Artificial Sequence
  Description of Artificial Sequence: Synthetic peptide
  N-term acetylated
  C-term amidated
LSWAADVQGVVTDGMASGLDKDYLKPDD

SEQ ID NO: 925 - protein, 28 aa, Artificial Sequence
  Description of Artificial Sequence: Synthetic peptide
  C-term amidated
LSTAADMWGVVTDGMASGLDKDYLKPDD

SEQ ID NO: 926 - protein, 28 aa, Artificial Sequence
  Description of Artificial Sequence: Synthetic peptide
  N-term acetylated
  C-term amidated
LSTAADMWGVVTDGMASGLDKDYLKPDD

SEQ ID NO: 927 - protein, 28 aa, Artificial Sequence
  Description of Artificial Sequence: Synthetic peptide
  C-term amidated
LSWAADMWGVVTDGMASGLDKDYLKPDD

SEQ ID NO: 928 - protein, 28 aa, Artificial Sequence
  Description of Artificial Sequence: Synthetic peptide
  N-term acetylated
  C-term amidated
LSWAADMWGVVTDGMASGLDKDYLKPDD

SEQ ID NO: 929 - protein, 28 aa, Artificial Sequence
  Description of Artificial Sequence: Synthetic peptide
  C-term amidated
LSTAADLWGVVTDGMASGLDKDYLKPDD

SEQ ID NO: 930 - protein, 28 aa, Artificial Sequence
  Description of Artificial Sequence: Synthetic peptide
  N-term acetylated
  C-term amidated
LSTAADLWGVVTDGMASGLDKDYLKPDD

SEQ ID NO: 931 - protein, 28 aa, Artificial Sequence
  Description of Artificial Sequence: Synthetic peptide
  C-term amidated
LSWAADLWGVVTDGMASGLDKDYLKPDD

SEQ ID NO: 932 - protein, 28 aa, Artificial Sequence
  Description of Artificial Sequence: Synthetic peptide
  N-term acetylated
  C-term amidated
LSWAADLWGVVTDGMASGLDKDYLKPDD

SEQ ID NO: 933 - protein, 28 aa, Artificial Sequence
  Description of Artificial Sequence: Synthetic peptide
  C-term amidated
LSTAADVWGVVTDGMASGLDKDYLKPDD

SEQ ID NO: 934 - protein, 28 aa, Artificial Sequence
  Description of Artificial Sequence: Synthetic peptide
  N-term acetylated
  C-term amidated
LSTAADVWGVVTDGMASGLDKDYLKPDD

SEQ ID NO: 935 - protein, 28 aa, Artificial Sequence
  Description of Artificial Sequence: Synthetic peptide
  C-term amidated
LSWAADVWGVVTDGMASGLDKDYLKPDD

SEQ ID NO: 936 - protein, 28 aa, Artificial Sequence
  Description of Artificial Sequence: Synthetic peptide
  N-term acetylated
  C-term amidated
LSWAADVWGVVTDGMASGLDKDYLKPDD

SEQ ID NO: 937 - protein, 28 aa, Artificial Sequence
  Description of Artificial Sequence: Synthetic peptide
  C-term amidated
LSTAADMQAVVTDGMASGLDKDYLKPDD

SEQ ID NO: 938 - protein, 28 aa, Artificial Sequence
  Description of Artificial Sequence: Synthetic peptide
  N-term acetylated
  C-term amidated
LSTAADMQAVVTDGMASGLDKDYLKPDD

SEQ ID NO: 939 - protein, 28 aa, Artificial Sequence
  Description of Artificial Sequence: Synthetic peptide
  C-term amidated
LSWAADMQAVVTDGMASGLDKDYLKPDD

SEQ ID NO: 940 - protein, 28 aa, Artificial Sequence
  Description of Artificial Sequence: Synthetic peptide
  N-term acetylated
  C-term amidated
LSWAADMQAVVTDGMASGLDKDYLKPDD

SEQ ID NO: 941 - protein, 28 aa, Artificial Sequence
  Description of Artificial Sequence: Synthetic peptide
  C-term amidated
LSTAADLQAVVTDGMASGLDKDYLKPDD

SEQ ID NO: 942 - protein, 28 aa, Artificial Sequence
  Description of Artificial Sequence: Synthetic peptide
  N-term acetylated
  C-term amidated
LSTAADLQAVVTDGMASGLDKDYLKPDD

SEQ ID NO: 943 - protein, 28 aa, Artificial Sequence
  Description of Artificial Sequence: Synthetic peptide
  C-term amidated
LSWAADLQAVVTDGMASGLDKDYLKPDD

SEQ ID NO: 944 - protein, 28 aa, Artificial Sequence
  Description of Artificial Sequence: Synthetic peptide
  N-term acetylated
  C-term amidated
LSWAADLQAVVTDGMASGLDKDYLKPDD

SEQ ID NO: 945 - protein, 28 aa, Artificial Sequence
  Description of Artificial Sequence: Synthetic peptide
  C-term amidated
LSTAADVQAVVTDGMASGLDKDYLKPDD

SEQ ID NO: 946 - protein, 28 aa, Artificial Sequence
  Description of Artificial Sequence: Synthetic peptide
  N-term acetylated
  C-term amidated
LSTAADVQAVVTDGMASGLDKDYLKPDD

SEQ ID NO: 947 - protein, 28 aa, Artificial Sequence
  Description of Artificial Sequence: Synthetic peptide
  C-term amidated
LSWAADVQAVVTDGMASGLDKDYLKPDD

SEQ ID NO: 948 - protein, 28 aa, Artificial Sequence
  Description of Artificial Sequence: Synthetic peptide
  N-term acetylated
  C-term amidated
LSWAADVQAVVTDGMASGLDKDYLKPDD

SEQ ID NO: 949 - protein, 28 aa, Artificial Sequence
  Description of Artificial Sequence: Synthetic peptide
  C-term amidated
LSTAADMWAVVTDGMASGLDKDYLKPDD

SEQ ID NO: 950 - protein, 28 aa, Artificial Sequence
  Description of Artificial Sequence: Synthetic peptide
  N-term acetylated
  C-term amidated
LSTAADMWAVVTDGMASGLDKDYLKPDD

SEQ ID NO: 951 - protein, 28 aa, Artificial Sequence
  Description of Artificial Sequence: Synthetic peptide
  C-term amidated
LSWAADMWAVVTDGMASGLDKDYLKPDD

SEQ ID NO: 952 - protein, 28 aa, Artificial Sequence
  Description of Artificial Sequence: Synthetic peptide
  N-term acetylated
  C-term amidated
LSWAADMWAVVTDGMASGLDKDYLKPDD

SEQ ID NO: 953 - protein, 28 aa, Artificial Sequence
  Description of Artificial Sequence: Synthetic peptide
  C-term amidated
LSTAADLWAVVTDGMASGLDKDYLKPDD

SEQ ID NO: 954 - protein, 28 aa, Artificial Sequence
  Description of Artificial Sequence: Synthetic peptide
  N-term acetylated
  C-term amidated
LSTAADLWAVVTDGMASGLDKDYLKPDD

SEQ ID NO: 955 - protein, 28 aa, Artificial Sequence
  Description of Artificial Sequence: Synthetic peptide
  C-term amidated
LSWAADLWAVVTDGMASGLDKDYLKPDD

SEQ ID NO: 956 - protein, 28 aa, Artificial Sequence
  Description of Artificial Sequence: Synthetic peptide
  N-term acetylated
  C-term amidated
LSWAADLWAVVTDGMASGLDKDYLKPDD

SEQ ID NO: 957 - protein, 28 aa, Artificial Sequence
  Description of Artificial Sequence: Synthetic peptide
  C-term amidated
LSTAADVWAVVTDGMASGLDKDYLKPDD

SEQ ID NO: 958 - protein, 28 aa, Artificial Sequence
  Description of Artificial Sequence: Synthetic peptide
  N-term acetylated
  C-term amidated
LSTAADVWAVVTDGMASGLDKDYLKPDD

SEQ ID NO: 959 - protein, 28 aa, Artificial Sequence
  Description of Artificial Sequence: Synthetic peptide
  C-term amidated
LSWAADVWAVVTDGMASGLDKDYLKPDD

SEQ ID NO: 960 - protein, 28 aa, Artificial Sequence
  Description of Artificial Sequence: Synthetic peptide
  N-term acetylated
  C-term amidated
LSWAADVWAVVTDGMASGLDKDYLKPDD

SEQ ID NO: 961 - protein, 28 aa, Artificial Sequence
  Description of Artificial Sequence: Synthetic peptide
  C-term amidated
LSTAADMQGVVWDGMASGLDKDYLKPDD

SEQ ID NO: 962 - protein, 28 aa, Artificial Sequence
  Description of Artificial Sequence: Synthetic peptide
  N-term acetylated
  C-term amidated
LSTAADMQGVVWDGMASGLDKDYLKPDD

SEQ ID NO: 963 - protein, 28 aa, Artificial Sequence
  Description of Artificial Sequence: Synthetic peptide
  C-term amidated
LSWAADMQGVVWDGMASGLDKDYLKPDD

SEQ ID NO: 964 - protein, 28 aa, Artificial Sequence
  Description of Artificial Sequence: Synthetic peptide
  N-term acetylated
  C-term amidated
LSWAADMQGVVWDGMASGLDKDYLKPDD

SEQ ID NO: 965 - protein, 28 aa, Artificial Sequence
  Description of Artificial Sequence: Synthetic peptide
  C-term amidated
LSTAADLQGVVWDGMASGLDKDYLKPDD

SEQ ID NO: 966 - protein, 28 aa, Artificial Sequence
  Description of Artificial Sequence: Synthetic peptide
  N-term acetylated
  C-term amidated
LSTAADLQGVVWDGMASGLDKDYLKPDD

SEQ ID NO: 967 - protein, 28 aa, Artificial Sequence
  Description of Artificial Sequence: Synthetic peptide
  C-term amidated
LSWAADLQGVVWDGMASGLDKDYLKPDD

SEQ ID NO: 968 - protein, 28 aa, Artificial Sequence
  Description of Artificial Sequence: Synthetic peptide
  N-term acetylated
  C-term amidated
LSWAADLQGVVWDGMASGLDKDYLKPDD

SEQ ID NO: 969 - protein, 28 aa, Artificial Sequence
  Description of Artificial Sequence: Synthetic peptide
  C-term amidated
LSTAADVQGVVWDGMASGLDKDYLKPDD

SEQ ID NO: 970 - protein, 28 aa, Artificial Sequence
  Description of Artificial Sequence: Synthetic peptide
  N-term acetylated
  C-term amidated
LSTAADVQGVVWDGMASGLDKDYLKPDD

SEQ ID NO: 971 - protein, 28 aa, Artificial Sequence
  Description of Artificial Sequence: Synthetic peptide
  C-term amidated
LSWAADVQGVVWDGMASGLDKDYLKPDD

SEQ ID NO: 972 - protein, 28 aa, Artificial Sequence
  Description of Artificial Sequence: Synthetic peptide
  N-term acetylated
  C-term amidated
LSWAADVQGVVWDGMASGLDKDYLKPDD

SEQ ID NO: 973 - protein, 28 aa, Artificial Sequence
  Description of Artificial Sequence: Synthetic peptide
  C-term amidated
LSTAADMWGVVWDGMASGLDKDYLKPDD

SEQ ID NO: 974 - protein, 28 aa, Artificial Sequence
  Description of Artificial Sequence: Synthetic peptide
  N-term acetylated
  C-term amidated
LSTAADMWGVVWDGMASGLDKDYLKPDD

SEQ ID NO: 975 - protein, 28 aa, Artificial Sequence
  Description of Artificial Sequence: Synthetic peptide
  C-term amidated
LSWAADMWGVVWDGMASGLDKDYLKPDD

SEQ ID NO: 976 - protein, 28 aa, Artificial Sequence
  Description of Artificial Sequence: Synthetic peptide
  N-term acetylated
  C-term amidated
LSWAADMWGVVWDGMASGLDKDYLKPDD

SEQ ID NO: 977 - protein, 28 aa, Artificial Sequence
  Description of Artificial Sequence: Synthetic peptide
  C-term amidated
LSTAADLWGVVWDGMASGLDKDYLKPDD

SEQ ID NO: 978 - protein, 28 aa, Artificial Sequence
  Description of Artificial Sequence: Synthetic peptide
  N-term acetylated
  C-term amidated
LSTAADLWGVVWDGMASGLDKDYLKPDD

SEQ ID NO: 979 - protein, 28 aa, Artificial Sequence
  Description of Artificial Sequence: Synthetic peptide
  C-term amidated
LSWAADLWGVVWDGMASGLDKDYLKPDD

SEQ ID NO: 980 - protein, 28 aa, Artificial Sequence
  Description of Artificial Sequence: Synthetic peptide
  N-term acetylated
  C-term amidated
LSWAADLWGVVWDGMASGLDKDYLKPDD

SEQ ID NO: 981 - protein, 28 aa, Artificial Sequence
  Description of Artificial Sequence: Synthetic peptide
  C-term amidated
LSTAADVWGVVWDGMASGLDKDYLKPDD

SEQ ID NO: 982 - protein, 28 aa, Artificial Sequence
  Description of Artificial Sequence: Synthetic peptide
  N-term acetylated
  C-term amidated
LSTAADVWGVVWDGMASGLDKDYLKPDD

SEQ ID NO: 983 - protein, 28 aa, Artificial Sequence
  Description of Artificial Sequence: Synthetic peptide
  C-term amidated
LSWAADVWGVVWDGMASGLDKDYLKPDD

SEQ ID NO: 984 - protein, 28 aa, Artificial Sequence
  Description of Artificial Sequence: Synthetic peptide
  N-term acetylated
  C-term amidated
LSWAADVWGVVWDGMASGLDKDYLKPDD

SEQ ID NO: 985 - protein, 28 aa, Artificial Sequence
  Description of Artificial Sequence: Synthetic peptide
  C-term amidated
LSTAADMQAVVWDGMASGLDKDYLKPDD

SEQ ID NO: 986 - protein, 28 aa, Artificial Sequence
  Description of Artificial Sequence: Synthetic peptide
  N-term acetylated
  C-term amidated
LSTAADMQAVVWDGMASGLDKDYLKPDD

SEQ ID NO: 987 - protein, 28 aa, Artificial Sequence
  Description of Artificial Sequence: Synthetic peptide
  C-term amidated
LSWAADMQAVVWDGMASGLDKDYLKPDD

SEQ ID NO: 988 - protein, 28 aa, Artificial Sequence
  Description of Artificial Sequence: Synthetic peptide
  N-term acetylated
  C-term amidated
LSWAADMQAVVWDGMASGLDKDYLKPDD

SEQ ID NO: 989 - protein, 28 aa, Artificial Sequence
  Description of Artificial Sequence: Synthetic peptide
  C-term amidated
LSTAADLQAVVWDGMASGLDKDYLKPDD

SEQ ID NO: 990 - protein, 28 aa, Artificial Sequence
  Description of Artificial Sequence: Synthetic peptide
  N-term acetylated
  C-term amidated
LSTAADLQAVVWDGMASGLDKDYLKPDD

SEQ ID NO: 991 - protein, 28 aa, Artificial Sequence
  Description of Artificial Sequence: Synthetic peptide
  C-term amidated
LSWAADLQAVVWDGMASGLDKDYLKPDD

SEQ ID NO: 992 - protein, 28 aa, Artificial Sequence
  Description of Artificial Sequence: Synthetic peptide
  N-term acetylated
  C-term amidated
LSWAADLQAVVWDGMASGLDKDYLKPDD

SEQ ID NO: 993 - protein, 28 aa, Artificial Sequence
  Description of Artificial Sequence: Synthetic peptide
  C-term amidated
LSTAADVQAVVWDGMASGLDKDYLKPDD

SEQ ID NO: 994 - protein, 28 aa, Artificial Sequence
  Description of Artificial Sequence: Synthetic peptide
  N-term acetylated
  C-term amidated
LSTAADVQAVVWDGMASGLDKDYLKPDD

SEQ ID NO: 995 - protein, 28 aa, Artificial Sequence
  Description of Artificial Sequence: Synthetic peptide
  C-term amidated
LSWAADVQAVVWDGMASGLDKDYLKPDD

SEQ ID NO: 996 - protein, 28 aa, Artificial Sequence
  Description of Artificial Sequence: Synthetic peptide
  N-term acetylated
  C-term amidated
LSWAADVQAVVWDGMASGLDKDYLKPDD

SEQ ID NO: 997 - protein, 28 aa, Artificial Sequence
  Description of Artificial Sequence: Synthetic peptide
  C-term amidated
LSTAADMWAVVWDGMASGLDKDYLKPDD

SEQ ID NO: 998 - protein, 28 aa, Artificial Sequence
  Description of Artificial Sequence: Synthetic peptide
  N-term acetylated
  C-term amidated
LSTAADMWAVVWDGMASGLDKDYLKPDD

SEQ ID NO: 999 - protein, 28 aa, Artificial Sequence
  Description of Artificial Sequence: Synthetic peptide
  C-term amidated
LSWAADMWAVVWDGMASGLDKDYLKPDD

SEQ ID NO: 1000 - protein, 28 aa, Artificial Sequence
  Description of Artificial Sequence: Synthetic peptide
  N-term acetylated
  C-term amidated
LSWAADMWAVVWDGMASGLDKDYLKPDD

SEQ ID NO: 1001 - protein, 28 aa, Artificial Sequence
  Description of Artificial Sequence: Synthetic peptide
  C-term amidated
LSTAADLWAVVWDGMASGLDKDYLKPDD

SEQ ID NO: 1002 - protein, 28 aa, Artificial Sequence
  Description of Artificial Sequence: Synthetic peptide
  N-term acetylated
  C-term amidated
LSTAADLWAVVWDGMASGLDKDYLKPDD

SEQ ID NO: 1003 - protein, 28 aa, Artificial Sequence
  Description of Artificial Sequence: Synthetic peptide
  C-term amidated
LSWAADLWAVVWDGMASGLDKDYLKPDD

SEQ ID NO: 1004 - protein, 28 aa, Artificial Sequence
  Description of Artificial Sequence: Synthetic peptide
  N-term acetylated
  C-term amidated
LSWAADLWAVVWDGMASGLDKDYLKPDD

SEQ ID NO: 1005 - protein, 28 aa, Artificial Sequence
  Description of Artificial Sequence: Synthetic peptide
  C-term amidated
LSTAADVWAVVWDGMASGLDKDYLKPDD

SEQ ID NO: 1006 - protein, 28 aa, Artificial Sequence
  Description of Artificial Sequence: Synthetic peptide
  N-term acetylated
  C-term amidated
LSTAADVWAVVWDGMASGLDKDYLKPDD

SEQ ID NO: 1007 - protein, 28 aa, Artificial Sequence
  Description of Artificial Sequence: Synthetic peptide
  C-term amidated
LSWAADVWAVVWDGMASGLDKDYLKPDD

SEQ ID NO: 1008 - protein, 28 aa, Artificial Sequence
  Description of Artificial Sequence: Synthetic peptide
  N-term acetylated
  C-term amidated
LSWAADVWAVVWDGMASGLDKDYLKPDD

SEQ ID NO: 1009 - protein, 28 aa, Artificial Sequence
  Description of Artificial Sequence: Synthetic peptide
  C-term amidated
LSTAADMQGVVTDTMASGLDKDYLKPDD

SEQ ID NO: 1010 - protein, 28 aa, Artificial Sequence
  Description of Artificial Sequence: Synthetic peptide
  N-term acetylated
  C-term amidated
LSTAADMQGVVTDTMASGLDKDYLKPDD

SEQ ID NO: 1011 - protein, 28 aa, Artificial Sequence
  Description of Artificial Sequence: Synthetic peptide
  C-term amidated
LSWAADMQGVVTDTMASGLDKDYLKPDD

SEQ ID NO: 1012 - protein, 28 aa, Artificial Sequence
  Description of Artificial Sequence: Synthetic peptide
  N-term acetylated
  C-term amidated
LSWAADMQGVVTDTMASGLDKDYLKPDD

SEQ ID NO: 1013 - protein, 28 aa, Artificial Sequence
  Description of Artificial Sequence: Synthetic peptide
  C-term amidated
LSTAADLQGVVTDTMASGLDKDYLKPDD

SEQ ID NO: 1014 - protein, 28 aa, Artificial Sequence
  Description of Artificial Sequence: Synthetic peptide
  N-term acetylated
  C-term amidated
LSTAADLQGVVTDTMASGLDKDYLKPDD

SEQ ID NO: 1015 - protein, 28 aa, Artificial Sequence
  Description of Artificial Sequence: Synthetic peptide
  C-term amidated
LSWAADLQGVVTDTMASGLDKDYLKPDD

SEQ ID NO: 1016 - protein, 28 aa, Artificial Sequence
  Description of Artificial Sequence: Synthetic peptide
  N-term acetylated
  C-term amidated
LSWAADLQGVVTDTMASGLDKDYLKPDD

SEQ ID NO: 1017 - protein, 28 aa, Artificial Sequence
  Description of Artificial Sequence: Synthetic peptide
  C-term amidated
LSTAADVQGVVTDTMASGLDKDYLKPDD

SEQ ID NO: 1018 - protein, 28 aa, Artificial Sequence
  Description of Artificial Sequence: Synthetic peptide
  N-term acetylated
  C-term amidated
LSTAADVQGVVTDTMASGLDKDYLKPDD

SEQ ID NO: 1019 - protein, 28 aa, Artificial Sequence
  Description of Artificial Sequence: Synthetic peptide
  C-term amidated
LSWAADVQGVVTDTMASGLDKDYLKPDD

SEQ ID NO: 1020 - protein, 28 aa, Artificial Sequence
  Description of Artificial Sequence: Synthetic peptide
  N-term acetylated
  C-term amidated
LSWAADVQGVVTDTMASGLDKDYLKPDD

SEQ ID NO: 1021 - protein, 28 aa, Artificial Sequence
  Description of Artificial Sequence: Synthetic peptide
  C-term amidated
LSTAADMWGVVTDTMASGLDKDYLKPDD

SEQ ID NO: 1022 - protein, 28 aa, Artificial Sequence
  Description of Artificial Sequence: Synthetic peptide
  N-term acetylated
  C-term amidated
LSTAADMWGVVTDTMASGLDKDYLKPDD

SEQ ID NO: 1023 - protein, 28 aa, Artificial Sequence
  Description of Artificial Sequence: Synthetic peptide
  C-term amidated
LSWAADMWGVVTDTMASGLDKDYLKPDD

SEQ ID NO: 1024 - protein, 28 aa, Artificial Sequence
  Description of Artificial Sequence: Synthetic peptide
  N-term acetylated
  C-term amidated
LSWAADMWGVVTDTMASGLDKDYLKPDD

SEQ ID NO: 1025 - protein, 28 aa, Artificial Sequence
  Description of Artificial Sequence: Synthetic peptide
  C-term amidated
LSTAADLWGVVTDTMASGLDKDYLKPDD

SEQ ID NO: 1026 - protein, 28 aa, Artificial Sequence
  Description of Artificial Sequence: Synthetic peptide
  N-term acetylated
  C-term amidated
LSTAADLWGVVTDTMASGLDKDYLKPDD

SEQ ID NO: 1027 - protein, 28 aa, Artificial Sequence
  Description of Artificial Sequence: Synthetic peptide
  C-term amidated
LSWAADLWGVVTDTMASGLDKDYLKPDD

SEQ ID NO: 1028 - protein, 28 aa, Artificial Sequence
  Description of Artificial Sequence: Synthetic peptide
  N-term acetylated
  C-term amidated
LSWAADLWGVVTDTMASGLDKDYLKPDD

SEQ ID NO: 1029 - protein, 28 aa, Artificial Sequence
  Description of Artificial Sequence: Synthetic peptide
  C-term amidated
LSTAADVWGVVTDTMASGLDKDYLKPDD

SEQ ID NO: 1030 - protein, 28 aa, Artificial Sequence
  Description of Artificial Sequence: Synthetic peptide
  N-term acetylated
  C-term amidated
LSTAADVWGVVTDTMASGLDKDYLKPDD

SEQ ID NO: 1031 - protein, 28 aa, Artificial Sequence
  Description of Artificial Sequence: Synthetic peptide
  C-term amidated
LSWAADVWGVVTDTMASGLDKDYLKPDD

SEQ ID NO: 1032 - protein, 28 aa, Artificial Sequence
  Description of Artificial Sequence: Synthetic peptide
  N-term acetylated
  C-term amidated
LSWAADVWGVVTDTMASGLDKDYLKPDD

SEQ ID NO: 1033 - protein, 28 aa, Artificial Sequence
  Description of Artificial Sequence: Synthetic peptide
  C-term amidated
LSTAADMQAVVTDTMASGLDKDYLKPDD

SEQ ID NO: 1034 - protein, 28 aa, Artificial Sequence
  Description of Artificial Sequence: Synthetic peptide
  N-term acetylated
  C-term amidated
LSTAADMQAVVTDTMASGLDKDYLKPDD

SEQ ID NO: 1035 - protein, 28 aa, Artificial Sequence
  Description of Artificial Sequence: Synthetic peptide
  C-term amidated
LSWAADMQAVVTDTMASGLDKDYLKPDD

SEQ ID NO: 1036 - protein, 28 aa, Artificial Sequence
  Description of Artificial Sequence: Synthetic peptide
  N-term acetylated
  C-term amidated
LSWAADMQAVVTDTMASGLDKDYLKPDD

SEQ ID NO: 1037 - protein, 28 aa, Artificial Sequence
  Description of Artificial Sequence: Synthetic peptide
  C-term amidated
LSTAADLQAVVTDTMASGLDKDYLKPDD

SEQ ID NO: 1038 - protein, 28 aa, Artificial Sequence
  Description of Artificial Sequence: Synthetic peptide
  N-term acetylated
  C-term amidated
LSTAADLQAVVTDTMASGLDKDYLKPDD

SEQ ID NO: 1039 - protein, 28 aa, Artificial Sequence
  Description of Artificial Sequence: Synthetic peptide
  C-term amidated
LSWAADLQAVVTDTMASGLDKDYLKPDD

SEQ ID NO: 1040 - protein, 28 aa, Artificial Sequence
  Description of Artificial Sequence: Synthetic peptide
  N-term acetylated
  C-term amidated
LSWAADLQAVVTDTMASGLDKDYLKPDD

SEQ ID NO: 1041 - protein, 28 aa, Artificial Sequence
  Description of Artificial Sequence: Synthetic peptide
  C-term amidated
LSTAADVQAVVTDTMASGLDKDYLKPDD

SEQ ID NO: 1042 - protein, 28 aa, Artificial Sequence
  Description of Artificial Sequence: Synthetic peptide
  N-term acetylated
  C-term amidated
LSTAADVQAVVTDTMASGLDKDYLKPDD

SEQ ID NO: 1043 - protein, 28 aa, Artificial Sequence
  Description of Artificial Sequence: Synthetic peptide
  C-term amidated
LSWAADVQAVVTDTMASGLDKDYLKPDD

SEQ ID NO: 1044 - protein, 28 aa, Artificial Sequence
  Description of Artificial Sequence: Synthetic peptide
  N-term acetylated
  C-term amidated
LSWAADVQAVVTDTMASGLDKDYLKPDD

SEQ ID NO: 1045 - protein, 28 aa, Artificial Sequence
  Description of Artificial Sequence: Synthetic peptide
  C-term amidated
LSTAADMWAVVTDTMASGLDKDYLKPDD

SEQ ID NO: 1046 - protein, 28 aa, Artificial Sequence
  Description of Artificial Sequence: Synthetic peptide
  N-term acetylated
  C-term amidated
LSTAADMWAVVTDTMASGLDKDYLKPDD

SEQ ID NO: 1047 - protein, 28 aa, Artificial Sequence
  Description of Artificial Sequence: Synthetic peptide
  C-term amidated
LSWAADMWAVVTDTMASGLDKDYLKPDD

SEQ ID NO: 1048 - protein, 28 aa, Artificial Sequence
  Description of Artificial Sequence: Synthetic peptide
  N-term acetylated
  C-term amidated
LSWAADMWAVVTDTMASGLDKDYLKPDD

SEQ ID NO: 1049 - protein, 28 aa, Artificial Sequence
  Description of Artificial Sequence: Synthetic peptide
  C-term amidated
LSTAADLWAVVTDTMASGLDKDYLKPDD

SEQ ID NO: 1050 - protein, 28 aa, Artificial Sequence
  Description of Artificial Sequence: Synthetic peptide
  N-term acetylated
  C-term amidated
LSTAADLWAVVTDTMASGLDKDYLKPDD

SEQ ID NO: 1051 - protein, 28 aa, Artificial Sequence
  Description of Artificial Sequence: Synthetic peptide
  C-term amidated
LSWAADLWAVVTDTMASGLDKDYLKPDD

SEQ ID NO: 1052 - protein, 28 aa, Artificial Sequence
  Description of Artificial Sequence: Synthetic peptide
  N-term acetylated
  C-term amidated
LSWAADLWAVVTDTMASGLDKDYLKPDD

SEQ ID NO: 1053 - protein, 28 aa, Artificial Sequence
  Description of Artificial Sequence: Synthetic peptide
  C-term amidated
LSTAADVWAVVTDTMASGLDKDYLKPDD

SEQ ID NO: 1054 - protein, 28 aa, Artificial Sequence
  Description of Artificial Sequence: Synthetic peptide
  N-term acetylated
  C-term amidated
LSTAADVWAVVTDTMASGLDKDYLKPDD

SEQ ID NO: 1055 - protein, 28 aa, Artificial Sequence
  Description of Artificial Sequence: Synthetic peptide
  C-term amidated
LSWAADVWAVVTDTMASGLDKDYLKPDD

SEQ ID NO: 1056 - protein, 28 aa, Artificial Sequence
  Description of Artificial Sequence: Synthetic peptide
  N-term acetylated
  C-term amidated
LSWAADVWAVVTDTMASGLDKDYLKPDD

SEQ ID NO: 1057 - protein, 28 aa, Artificial Sequence
  Description of Artificial Sequence: Synthetic peptide
  C-term amidated
LSTAADMQGVVWDTMASGLDKDYLKPDD

SEQ ID NO: 1058 - protein, 28 aa, Artificial Sequence
  Description of Artificial Sequence: Synthetic peptide
  N-term acetylated
  C-term amidated
LSTAADMQGVVWDTMASGLDKDYLKPDD

SEQ ID NO: 1059 - protein, 28 aa, Artificial Sequence
  Description of Artificial Sequence: Synthetic peptide
  C-term amidated
LSWAADMQGVVWDTMASGLDKDYLKPDD

SEQ ID NO: 1060 - protein, 28 aa, Artificial Sequence
  Description of Artificial Sequence: Synthetic peptide
  N-term acetylated
  C-term amidated
LSWAADMQGVVWDTMASGLDKDYLKPDD

SEQ ID NO: 1061 - protein, 28 aa, Artificial Sequence
  Description of Artificial Sequence: Synthetic peptide
  C-term amidated
LSTAADLQGVVWDTMASGLDKDYLKPDD

SEQ ID NO: 1062 - protein, 28 aa, Artificial Sequence
  Description of Artificial Sequence: Synthetic peptide
  N-term acetylated
  C-term amidated
LSTAADLQGVVWDTMASGLDKDYLKPDD

SEQ ID NO: 1063 - protein, 28 aa, Artificial Sequence
  Description of Artificial Sequence: Synthetic peptide
  C-term amidated
LSWAADLQGVVWDTMASGLDKDYLKPDD

SEQ ID NO: 1064 - protein, 28 aa, Artificial Sequence
  Description of Artificial Sequence: Synthetic peptide
  N-term acetylated
  C-term amidated
LSWAADLQGVVWDTMASGLDKDYLKPDD

SEQ ID NO: 1065 - protein, 28 aa, Artificial Sequence
  Description of Artificial Sequence: Synthetic peptide
  C-term amidated
LSTAADVQGVVWDTMASGLDKDYLKPDD

SEQ ID NO: 1066 - protein, 28 aa, Artificial Sequence
  Description of Artificial Sequence: Synthetic peptide
  N-term acetylated
  C-term amidated
LSTAADVQGVVWDTMASGLDKDYLKPDD

SEQ ID NO: 1067 - protein, 28 aa, Artificial Sequence
  Description of Artificial Sequence: Synthetic peptide
  C-term amidated
LSWAADVQGVVWDTMASGLDKDYLKPDD

SEQ ID NO: 1068 - protein, 28 aa, Artificial Sequence
  Description of Artificial Sequence: Synthetic peptide
  N-term acetylated
  C-term amidated
LSWAADVQGVVWDTMASGLDKDYLKPDD

SEQ ID NO: 1069 - protein, 28 aa, Artificial Sequence
  Description of Artificial Sequence: Synthetic peptide
  C-term amidated
LSTAADMWGVVWDTMASGLDKDYLKPDD

SEQ ID NO: 1070 - protein, 28 aa, Artificial Sequence
  Description of Artificial Sequence: Synthetic peptide
  N-term acetylated
  C-term amidated
LSTAADMWGVVWDTMASGLDKDYLKPDD

SEQ ID NO: 1071 - protein, 28 aa, Artificial Sequence
  Description of Artificial Sequence: Synthetic peptide
  C-term amidated
LSWAADMWGVVWDTMASGLDKDYLKPDD

SEQ ID NO: 1072 - protein, 28 aa, Artificial Sequence
  Description of Artificial Sequence: Synthetic peptide
  N-term acetylated
  C-term amidated
LSWAADMWGVVWDTMASGLDKDYLKPDD

SEQ ID NO: 1073 - protein, 28 aa, Artificial Sequence
  Description of Artificial Sequence: Synthetic peptide
  C-term amidated
LSTAADLWGVVWDTMASGLDKDYLKPDD

SEQ ID NO: 1074 - protein, 28 aa, Artificial Sequence
  Description of Artificial Sequence: Synthetic peptide
  N-term acetylated
  C-term amidated
LSTAADLWGVVWDTMASGLDKDYLKPDD

SEQ ID NO: 1075 - protein, 28 aa, Artificial Sequence
  Description of Artificial Sequence: Synthetic peptide
  C-term amidated
LSWAADLWGVVWDTMASGLDKDYLKPDD

SEQ ID NO: 1076 - protein, 28 aa, Artificial Sequence
  Description of Artificial Sequence: Synthetic peptide
  N-term acetylated
  C-term amidated
LSWAADLWGVVWDTMASGLDKDYLKPDD

SEQ ID NO: 1077 - protein, 28 aa, Artificial Sequence
  Description of Artificial Sequence: Synthetic peptide
  C-term amidated
LSTAADVWGVVWDTMASGLDKDYLKPDD

SEQ ID NO: 1078 - protein, 28 aa, Artificial Sequence
  Description of Artificial Sequence: Synthetic peptide
  N-term acetylated
  C-term amidated
LSTAADVWGVVWDTMASGLDKDYLKPDD

SEQ ID NO: 1079 - protein, 28 aa, Artificial Sequence
  Description of Artificial Sequence: Synthetic peptide
  C-term amidated
LSWAADVWGVVWDTMASGLDKDYLKPDD

SEQ ID NO: 1080 - protein, 28 aa, Artificial Sequence
  Description of Artificial Sequence: Synthetic peptide
  N-term acetylated
  C-term amidated
LSWAADVWGVVWDTMASGLDKDYLKPDD

SEQ ID NO: 1081 - protein, 28 aa, Artificial Sequence
  Description of Artificial Sequence: Synthetic peptide
  C-term amidated
LSTAADMQAVVWDTMASGLDKDYLKPDD

SEQ ID NO: 1082 - protein, 28 aa, Artificial Sequence
  Description of Artificial Sequence: Synthetic peptide
  N-term acetylated
  C-term amidated
LSTAADMQAVVWDTMASGLDKDYLKPDD

SEQ ID NO: 1083 - protein, 28 aa, Artificial Sequence
  Description of Artificial Sequence: Synthetic peptide
  C-term amidated
LSWAADMQAVVWDTMASGLDKDYLKPDD

SEQ ID NO: 1084 - protein, 28 aa, Artificial Sequence
  Description of Artificial Sequence: Synthetic peptide
  N-term acetylated
  C-term amidated
LSWAADMQAVVWDTMASGLDKDYLKPDD

SEQ ID NO: 1085 - protein, 28 aa, Artificial Sequence
  Description of Artificial Sequence: Synthetic peptide
  C-term amidated
LSTAADLQAVVWDTMASGLDKDYLKPDD

SEQ ID NO: 1086 - protein, 28 aa, Artificial Sequence
  Description of Artificial Sequence: Synthetic peptide
  N-term acetylated
  C-term amidated
LSTAADLQAVVWDTMASGLDKDYLKPDD

SEQ ID NO: 1087 - protein, 28 aa, Artificial Sequence
  Description of Artificial Sequence: Synthetic peptide
  C-term amidated
LSWAADLQAVVWDTMASGLDKDYLKPDD

SEQ ID NO: 1088 - protein, 28 aa, Artificial Sequence
  Description of Artificial Sequence: Synthetic peptide
  N-term acetylated
  C-term amidated
LSWAADLQAVVWDTMASGLDKDYLKPDD

SEQ ID NO: 1089 - protein, 28 aa, Artificial Sequence
  Description of Artificial Sequence: Synthetic peptide
  C-term amidated
LSTAADVQAVVWDTMASGLDKDYLKPDD

SEQ ID NO: 1090 - protein, 28 aa, Artificial Sequence
  Description of Artificial Sequence: Synthetic peptide
  N-term acetylated
  C-term amidated
LSTAADVQAVVWDTMASGLDKDYLKPDD

SEQ ID NO: 1091 - protein, 28 aa, Artificial Sequence
  Description of Artificial Sequence: Synthetic peptide
  C-term amidated
LSWAADVQAVVWDTMASGLDKDYLKPDD

SEQ ID NO: 1092 - protein, 28 aa, Artificial Sequence
  Description of Artificial Sequence: Synthetic peptide
  N-term acetylated
  C-term amidated
LSWAADVQAVVWDTMASGLDKDYLKPDD

SEQ ID NO: 1093 - protein, 28 aa, Artificial Sequence
  Description of Artificial Sequence: Synthetic peptide
  C-term amidated
LSTAADMWAVVWDTMASGLDKDYLKPDD

SEQ ID NO: 1094 - protein, 28 aa, Artificial Sequence
  Description of Artificial Sequence: Synthetic peptide
  N-term acetylated
  C-term amidated
LSTAADMWAVVWDTMASGLDKDYLKPDD

SEQ ID NO: 1095 - protein, 28 aa, Artificial Sequence
  Description of Artificial Sequence: Synthetic peptide
  C-term amidated
LSWAADMWAVVWDTMASGLDKDYLKPDD

SEQ ID NO: 1096 - protein, 28 aa, Artificial Sequence
  Description of Artificial Sequence: Synthetic peptide
  N-term acetylated
  C-term amidated
LSWAADMWAVVWDTMASGLDKDYLKPDD

SEQ ID NO: 1097 - protein, 28 aa, Artificial Sequence
  Description of Artificial Sequence: Synthetic peptide
  C-term amidated
LSTAADLWAVVWDTMASGLDKDYLKPDD

SEQ ID NO: 1098 - protein, 28 aa, Artificial Sequence
  Description of Artificial Sequence: Synthetic peptide
  N-term acetylated
  C-term amidated
LSTAADLWAVVWDTMASGLDKDYLKPDD

SEQ ID NO: 1099 - protein, 28 aa, Artificial Sequence
  Description of Artificial Sequence: Synthetic peptide
  C-term amidated
LSWAADLWAVVWDTMASGLDKDYLKPDD

SEQ ID NO: 1100 - protein, 28 aa, Artificial Sequence
  Description of Artificial Sequence: Synthetic peptide
  N-term acetylated
  C-term amidated
LSWAADLWAVVWDTMASGLDKDYLKPDD

SEQ ID NO: 1101 - protein, 28 aa, Artificial Sequence
  Description of Artificial Sequence: Synthetic peptide
  C-term amidated
LSTAADVWAVVWDTMASGLDKDYLKPDD

SEQ ID NO: 1102 - protein, 28 aa, Artificial Sequence
  Description of Artificial Sequence: Synthetic peptide
  N-term acetylated
  C-term amidated
LSTAADVWAVVWDTMASGLDKDYLKPDD

SEQ ID NO: 1103 - protein, 28 aa, Artificial Sequence
  Description of Artificial Sequence: Synthetic peptide
  C-term amidated
LSWAADVWAVVWDTMASGLDKDYLKPDD

SEQ ID NO: 1104 - protein, 28 aa, Artificial Sequence
  Description of Artificial Sequence: Synthetic peptide
  N-term acetylated
  C-term amidated
LSWAADVWAVVWDTMASGLDKDYLKPDD

SEQ ID NO: 1105 - protein, 28 aa, Artificial Sequence
  Description of Artificial Sequence: Synthetic peptide
  C-term amidated
LSTAADMQGVVTDWMASGLDKDYLKPDD

SEQ ID NO: 1106 - protein, 28 aa, Artificial Sequence
  Description of Artificial Sequence: Synthetic peptide
  N-term acetylated
  C-term amidated
LSTAADMQGVVTDWMASGLDKDYLKPDD

SEQ ID NO: 1107 - protein, 28 aa, Artificial Sequence
  Description of Artificial Sequence: Synthetic peptide
  C-term amidated
LSWAADMQGVVTDWMASGLDKDYLKPDD

SEQ ID NO: 1108 - protein, 28 aa, Artificial Sequence
  Description of Artificial Sequence: Synthetic peptide
  N-term acetylated
  C-term amidated
LSWAADMQGVVTDWMASGLDKDYLKPDD

SEQ ID NO: 1109 - protein, 28 aa, Artificial Sequence
  Description of Artificial Sequence: Synthetic peptide
  C-term amidated
LSTAADLQGVVTDWMASGLDKDYLKPDD

SEQ ID NO: 1110 - protein, 28 aa, Artificial Sequence
  Description of Artificial Sequence: Synthetic peptide
  N-term acetylated
  C-term amidated
LSTAADLQGVVTDWMASGLDKDYLKPDD

SEQ ID NO: 1111 - protein, 28 aa, Artificial Sequence
  Description of Artificial Sequence: Synthetic peptide
  C-term amidated
LSWAADLQGVVTDWMASGLDKDYLKPDD

SEQ ID NO: 1112 - protein, 28 aa, Artificial Sequence
  Description of Artificial Sequence: Synthetic peptide
  N-term acetylated
  C-term amidated
LSWAADLQGVVTDWMASGLDKDYLKPDD

SEQ ID NO: 1113 - protein, 28 aa, Artificial Sequence
  Description of Artificial Sequence: Synthetic peptide
  C-term amidated
LSTAADVQGVVTDWMASGLDKDYLKPDD

SEQ ID NO: 1114 - protein, 28 aa, Artificial Sequence
  Description of Artificial Sequence: Synthetic peptide
  N-term acetylated
  C-term amidated
LSTAADVQGVVTDWMASGLDKDYLKPDD

SEQ ID NO: 1115 - protein, 28 aa, Artificial Sequence
  Description of Artificial Sequence: Synthetic peptide
  C-term amidated
LSWAADVQGVVTDWMASGLDKDYLKPDD

SEQ ID NO: 1116 - protein, 28 aa, Artificial Sequence
  Description of Artificial Sequence: Synthetic peptide
  N-term acetylated
  C-term amidated
LSWAADVQGVVTDWMASGLDKDYLKPDD

SEQ ID NO: 1117 - protein, 28 aa, Artificial Sequence
  Description of Artificial Sequence: Synthetic peptide
  C-term amidated
LSTAADMWGVVTDWMASGLDKDYLKPDD

SEQ ID NO: 1118 - protein, 28 aa, Artificial Sequence
  Description of Artificial Sequence: Synthetic peptide
  N-term acetylated
  C-term amidated
LSTAADMWGVVTDWMASGLDKDYLKPDD

SEQ ID NO: 1119 - protein, 28 aa, Artificial Sequence
  Description of Artificial Sequence: Synthetic peptide
  C-term amidated
LSWAADMWGVVTDWMASGLDKDYLKPDD

SEQ ID NO: 1120 - protein, 28 aa, Artificial Sequence
  Description of Artificial Sequence: Synthetic peptide
  N-term acetylated
  C-term amidated
LSWAADMWGVVTDWMASGLDKDYLKPDD

SEQ ID NO: 1121 - protein, 28 aa, Artificial Sequence
  Description of Artificial Sequence: Synthetic peptide
  C-term amidated
LSTAADLWGVVTDWMASGLDKDYLKPDD

SEQ ID NO: 1122 - protein, 28 aa, Artificial Sequence
  Description of Artificial Sequence: Synthetic peptide
  N-term acetylated
  C-term amidated
LSTAADLWGVVTDWMASGLDKDYLKPDD

SEQ ID NO: 1123 - protein, 28 aa, Artificial Sequence
  Description of Artificial Sequence: Synthetic peptide
  C-term amidated
LSWAADLWGVVTDWMASGLDKDYLKPDD

SEQ ID NO: 1124 - protein, 28 aa, Artificial Sequence
  Description of Artificial Sequence: Synthetic peptide
  N-term acetylated
  C-term amidated
LSWAADLWGVVTDWMASGLDKDYLKPDD

SEQ ID NO: 1125 - protein, 28 aa, Artificial Sequence
  Description of Artificial Sequence: Synthetic peptide
  C-term amidated
LSTAADVWGVVTDWMASGLDKDYLKPDD

SEQ ID NO: 1126 - protein, 28 aa, Artificial Sequence
  Description of Artificial Sequence: Synthetic peptide
  N-term acetylated
  C-term amidated
LSTAADVWGVVTDWMASGLDKDYLKPDD

SEQ ID NO: 1127 - protein, 28 aa, Artificial Sequence
  Description of Artificial Sequence: Synthetic peptide
  C-term amidated
LSWAADVWGVVTDWMASGLDKDYLKPDD

SEQ ID NO: 1128 - protein, 28 aa, Artificial Sequence
  Description of Artificial Sequence: Synthetic peptide
  N-term acetylated
  C-term amidated
LSWAADVWGVVTDWMASGLDKDYLKPDD

SEQ ID NO: 1129 - protein, 28 aa, Artificial Sequence
  Description of Artificial Sequence: Synthetic peptide
  C-term amidated
LSTAADMQAVVTDWMASGLDKDYLKPDD

SEQ ID NO: 1130 - protein, 28 aa, Artificial Sequence
  Description of Artificial Sequence: Synthetic peptide
  N-term acetylated
  C-term amidated
LSTAADMQAVVTDWMASGLDKDYLKPDD

SEQ ID NO: 1131 - protein, 28 aa, Artificial Sequence
  Description of Artificial Sequence: Synthetic peptide
  C-term amidated
LSWAADMQAVVTDWMASGLDKDYLKPDD

SEQ ID NO: 1132 - protein, 28 aa, Artificial Sequence
  Description of Artificial Sequence: Synthetic peptide
  N-term acetylated
  C-term amidated
LSWAADMQAVVTDWMASGLDKDYLKPDD

SEQ ID NO: 1133 - protein, 28 aa, Artificial Sequence
  Description of Artificial Sequence: Synthetic peptide
  C-term amidated
LSTAADLQAVVTDWMASGLDKDYLKPDD

SEQ ID NO: 1134 - protein, 28 aa, Artificial Sequence
  Description of Artificial Sequence: Synthetic peptide
  N-term acetylated
  C-term amidated
LSTAADLQAVVTDWMASGLDKDYLKPDD

SEQ ID NO: 1135 - protein, 28 aa, Artificial Sequence
  Description of Artificial Sequence: Synthetic peptide
  C-term amidated
LSWAADLQAVVTDWMASGLDKDYLKPDD

SEQ ID NO: 1136 - protein, 28 aa, Artificial Sequence
  Description of Artificial Sequence: Synthetic peptide
  N-term acetylated
  C-term amidated
LSWAADLQAVVTDWMASGLDKDYLKPDD

SEQ ID NO: 1137 - protein, 28 aa, Artificial Sequence
  Description of Artificial Sequence: Synthetic peptide
  C-term amidated
LSTAADVQAVVTDWMASGLDKDYLKPDD

SEQ ID NO: 1138 - protein, 28 aa, Artificial Sequence
  Description of Artificial Sequence: Synthetic peptide
  N-term acetylated
  C-term amidated
LSTAADVQAVVTDWMASGLDKDYLKPDD

SEQ ID NO: 1139 - protein, 28 aa, Artificial Sequence
  Description of Artificial Sequence: Synthetic peptide
  C-term amidated
LSWAADVQAVVTDWMASGLDKDYLKPDD

SEQ ID NO: 1140 - protein, 28 aa, Artificial Sequence
  Description of Artificial Sequence: Synthetic peptide
  N-term acetylated
  C-term amidated
LSWAADVQAVVTDWMASGLDKDYLKPDD

SEQ ID NO: 1141 - protein, 28 aa, Artificial Sequence
  Description of Artificial Sequence: Synthetic peptide
  C-term amidated
LSTAADMWAVVTDWMASGLDKDYLKPDD

SEQ ID NO: 1142 - protein, 28 aa, Artificial Sequence
  Description of Artificial Sequence: Synthetic peptide
  N-term acetylated
  C-term amidated
LSTAADMWAVVTDWMASGLDKDYLKPDD

SEQ ID NO: 1143 - protein, 28 aa, Artificial Sequence
  Description of Artificial Sequence: Synthetic peptide
  C-term amidated
LSWAADMWAVVTDWMASGLDKDYLKPDD

SEQ ID NO: 1144 - protein, 28 aa, Artificial Sequence
  Description of Artificial Sequence: Synthetic peptide
  N-term acetylated
  C-term amidated
LSWAADMWAVVTDWMASGLDKDYLKPDD

SEQ ID NO: 1145 - protein, 28 aa, Artificial Sequence
  Description of Artificial Sequence: Synthetic peptide
  C-term amidated
LSTAADLWAVVTDWMASGLDKDYLKPDD

SEQ ID NO: 1146 - protein, 28 aa, Artificial Sequence
  Description of Artificial Sequence: Synthetic peptide
  N-term acetylated
  C-term amidated
LSTAADLWAVVTDWMASGLDKDYLKPDD

SEQ ID NO: 1147 - protein, 28 aa, Artificial Sequence
  Description of Artificial Sequence: Synthetic peptide
  C-term amidated
LSWAADLWAVVTDWMASGLDKDYLKPDD

SEQ ID NO: 1148 - protein, 28 aa, Artificial Sequence
  Description of Artificial Sequence: Synthetic peptide
  N-term acetylated
  C-term amidated
LSWAADLWAVVTDWMASGLDKDYLKPDD

SEQ ID NO: 1149 - protein, 28 aa, Artificial Sequence
  Description of Artificial Sequence: Synthetic peptide
  C-term amidated
LSTAADVWAVVTDWMASGLDKDYLKPDD

SEQ ID NO: 1150 - protein, 28 aa, Artificial Sequence
  Description of Artificial Sequence: Synthetic peptide
  N-term acetylated
  C-term amidated
LSTAADVWAVVTDWMASGLDKDYLKPDD

SEQ ID NO: 1151 - protein, 28 aa, Artificial Sequence
  Description of Artificial Sequence: Synthetic peptide
  C-term amidated
LSWAADVWAVVTDWMASGLDKDYLKPDD

SEQ ID NO: 1152 - protein, 28 aa, Artificial Sequence
  Description of Artificial Sequence: Synthetic peptide
  N-term acetylated
  C-term amidated
LSWAADVWAVVTDWMASGLDKDYLKPDD

SEQ ID NO: 1153 - protein, 28 aa, Artificial Sequence
  Description of Artificial Sequence: Synthetic peptide
  C-term amidated
LSTAADMQGVVWDWMASGLDKDYLKPDD

SEQ ID NO: 1154 - protein, 28 aa, Artificial Sequence
  Description of Artificial Sequence: Synthetic peptide
  N-term acetylated
  C-term amidated
LSTAADMQGVVWDWMASGLDKDYLKPDD

SEQ ID NO: 1155 - protein, 28 aa, Artificial Sequence
  Description of Artificial Sequence: Synthetic peptide
  C-term amidated
LSWAADMQGVVWDWMASGLDKDYLKPDD

SEQ ID NO: 1156 - protein, 28 aa, Artificial Sequence
  Description of Artificial Sequence: Synthetic peptide
  N-term acetylated
  C-term amidated
LSWAADMQGVVWDWMASGLDKDYLKPDD

SEQ ID NO: 1157 - protein, 28 aa, Artificial Sequence
  Description of Artificial Sequence: Synthetic peptide
  C-term amidated
LSTAADLQGVVWDWMASGLDKDYLKPDD

SEQ ID NO: 1158 - protein, 28 aa, Artificial Sequence
  Description of Artificial Sequence: Synthetic peptide
  N-term acetylated
  C-term amidated
LSTAADLQGVVWDWMASGLDKDYLKPDD

SEQ ID NO: 1159 - protein, 28 aa, Artificial Sequence
  Description of Artificial Sequence: Synthetic peptide
  C-term amidated
LSWAADLQGVVWDWMASGLDKDYLKPDD

SEQ ID NO: 1160 - protein, 28 aa, Artificial Sequence
  Description of Artificial Sequence: Synthetic peptide
  N-term acetylated
  C-term amidated
LSWAADLQGVVWDWMASGLDKDYLKPDD

SEQ ID NO: 1161 - protein, 28 aa, Artificial Sequence
  Description of Artificial Sequence: Synthetic peptide
  C-term amidated
LSTAADVQGVVWDWMASGLDKDYLKPDD

SEQ ID NO: 1162 - protein, 28 aa, Artificial Sequence
  Description of Artificial Sequence: Synthetic peptide
  N-term acetylated
  C-term amidated
LSTAADVQGVVWDWMASGLDKDYLKPDD

SEQ ID NO: 1163 - protein, 28 aa, Artificial Sequence
  Description of Artificial Sequence: Synthetic peptide
  C-term amidated
LSWAADVQGVVWDWMASGLDKDYLKPDD

SEQ ID NO: 1164 - protein, 28 aa, Artificial Sequence
  Description of Artificial Sequence: Synthetic peptide
  N-term acetylated
  C-term amidated
LSWAADVQGVVWDWMASGLDKDYLKPDD

SEQ ID NO: 1165 - protein, 28 aa, Artificial Sequence
  Description of Artificial Sequence: Synthetic peptide
  C-term amidated
LSTAADMWGVVWDWMASGLDKDYLKPDD

SEQ ID NO: 1166 - protein, 28 aa, Artificial Sequence
  Description of Artificial Sequence: Synthetic peptide
  N-term acetylated
  C-term amidated
LSTAADMWGVVWDWMASGLDKDYLKPDD

SEQ ID NO: 1167 - protein, 28 aa, Artificial Sequence
  Description of Artificial Sequence: Synthetic peptide
  C-term amidated
LSWAADMWGVVWDWMASGLDKDYLKPDD

SEQ ID NO: 1168 - protein, 28 aa, Artificial Sequence
  Description of Artificial Sequence: Synthetic peptide
  N-term acetylated
  C-term amidated
LSWAADMWGVVWDWMASGLDKDYLKPDD

SEQ ID NO: 1169 - protein, 28 aa, Artificial Sequence
  Description of Artificial Sequence: Synthetic peptide
  C-term amidated
LSTAADLWGVVWDWMASGLDKDYLKPDD

SEQ ID NO: 1170 - protein, 28 aa, Artificial Sequence
  Description of Artificial Sequence: Synthetic peptide
  N-term acetylated
  C-term amidated
LSTAADLWGVVWDWMASGLDKDYLKPDD

SEQ ID NO: 1171 - protein, 28 aa, Artificial Sequence
  Description of Artificial Sequence: Synthetic peptide
  C-term amidated
LSWAADLWGVVWDWMASGLDKDYLKPDD

SEQ ID NO: 1172 - protein, 28 aa, Artificial Sequence
  Description of Artificial Sequence: Synthetic peptide
  N-term acetylated
  C-term amidated
LSWAADLWGVVWDWMASGLDKDYLKPDD

SEQ ID NO: 1173 - protein, 28 aa, Artificial Sequence
  Description of Artificial Sequence: Synthetic peptide
  C-term amidated
LSTAADVWGVVWDWMASGLDKDYLKPDD

SEQ ID NO: 1174 - protein, 28 aa, Artificial Sequence
  Description of Artificial Sequence: Synthetic peptide
  N-term acetylated
  C-term amidated
LSTAADVWGVVWDWMASGLDKDYLKPDD

SEQ ID NO: 1175 - protein, 28 aa, Artificial Sequence
  Description of Artificial Sequence: Synthetic peptide
  C-term amidated
LSWAADVWGVVWDWMASGLDKDYLKPDD

SEQ ID NO: 1176 - protein, 28 aa, Artificial Sequence
  Description of Artificial Sequence: Synthetic peptide
  N-term acetylated
  C-term amidated
LSWAADVWGVVWDWMASGLDKDYLKPDD

SEQ ID NO: 1177 - protein, 28 aa, Artificial Sequence
  Description of Artificial Sequence: Synthetic peptide
  C-term amidated
LSTAADMQAVVWDWMASGLDKDYLKPDD

SEQ ID NO: 1178 - protein, 28 aa, Artificial Sequence
  Description of Artificial Sequence: Synthetic peptide
  N-term acetylated
  C-term amidated
LSTAADMQAVVWDWMASGLDKDYLKPDD

SEQ ID NO: 1179 - protein, 28 aa, Artificial Sequence
  Description of Artificial Sequence: Synthetic peptide
  C-term amidated
LSWAADMQAVVWDWMASGLDKDYLKPDD

SEQ ID NO: 1180 - protein, 28 aa, Artificial Sequence
  Description of Artificial Sequence: Synthetic peptide
  N-term acetylated
  C-term amidated
LSWAADMQAVVWDWMASGLDKDYLKPDD

SEQ ID NO: 1181 - protein, 28 aa, Artificial Sequence
  Description of Artificial Sequence: Synthetic peptide
  C-term amidated
LSTAADLQAVVWDWMASGLDKDYLKPDD

SEQ ID NO: 1182 - protein, 28 aa, Artificial Sequence
  Description of Artificial Sequence: Synthetic peptide
  N-term acetylated
  C-term amidated
LSTAADLQAVVWDWMASGLDKDYLKPDD

SEQ ID NO: 1183 - protein, 28 aa, Artificial Sequence
  Description of Artificial Sequence: Synthetic peptide
  C-term amidated
LSWAADLQAVVWDWMASGLDKDYLKPDD

SEQ ID NO: 1184 - protein, 28 aa, Artificial Sequence
  Description of Artificial Sequence: Synthetic peptide
  N-term acetylated
  C-term amidated
LSWAADLQAVVWDWMASGLDKDYLKPDD

SEQ ID NO: 1185 - protein, 28 aa, Artificial Sequence
  Description of Artificial Sequence: Synthetic peptide
  C-term amidated
LSTAADVQAVVWDWMASGLDKDYLKPDD

SEQ ID NO: 1186 - protein, 28 aa, Artificial Sequence
  Description of Artificial Sequence: Synthetic peptide
  N-term acetylated
  C-term amidated
LSTAADVQAVVWDWMASGLDKDYLKPDD

SEQ ID NO: 1187 - protein, 28 aa, Artificial Sequence
  Description of Artificial Sequence: Synthetic peptide
  C-term amidated
LSWAADVQAVVWDWMASGLDKDYLKPDD

SEQ ID NO: 1188 - protein, 28 aa, Artificial Sequence
  Description of Artificial Sequence: Synthetic peptide
  N-term acetylated
  C-term amidated
LSWAADVQAVVWDWMASGLDKDYLKPDD

SEQ ID NO: 1189 - protein, 28 aa, Artificial Sequence
  Description of Artificial Sequence: Synthetic peptide
  C-term amidated
LSTAADMWAVVWDWMASGLDKDYLKPDD

SEQ ID NO: 1190 - protein, 28 aa, Artificial Sequence
  Description of Artificial Sequence: Synthetic peptide
  N-term acetylated
  C-term amidated
LSTAADMWAVVWDWMASGLDKDYLKPDD

SEQ ID NO: 1191 - protein, 28 aa, Artificial Sequence
  Description of Artificial Sequence: Synthetic peptide
  C-term amidated
LSWAADMWAVVWDWMASGLDKDYLKPDD

SEQ ID NO: 1192 - protein, 28 aa, Artificial Sequence
  Description of Artificial Sequence: Synthetic peptide
  N-term acetylated
  C-term amidated
LSWAADMWAVVWDWMASGLDKDYLKPDD

SEQ ID NO: 1193 - protein, 28 aa, Artificial Sequence
  Description of Artificial Sequence: Synthetic peptide
  C-term amidated
LSTAADLWAVVWDWMASGLDKDYLKPDD

SEQ ID NO: 1194 - protein, 28 aa, Artificial Sequence
  Description of Artificial Sequence: Synthetic peptide
  N-term acetylated
  C-term amidated
LSTAADLWAVVWDWMASGLDKDYLKPDD

SEQ ID NO: 1195 - protein, 28 aa, Artificial Sequence
  Description of Artificial Sequence: Synthetic peptide
  C-term amidated
LSWAADLWAVVWDWMASGLDKDYLKPDD

SEQ ID NO: 1196 - protein, 28 aa, Artificial Sequence
  Description of Artificial Sequence: Synthetic peptide
  N-term acetylated
  C-term amidated
LSWAADLWAVVWDWMASGLDKDYLKPDD

SEQ ID NO: 1197 - protein, 28 aa, Artificial Sequence
  Description of Artificial Sequence: Synthetic peptide
  C-term amidated
LSTAADVWAVVWDWMASGLDKDYLKPDD

SEQ ID NO: 1198 - protein, 28 aa, Artificial Sequence
  Description of Artificial Sequence: Synthetic peptide
  N-term acetylated
  C-term amidated
LSTAADVWAVVWDWMASGLDKDYLKPDD

SEQ ID NO: 1199 - protein, 28 aa, Artificial Sequence
  Description of Artificial Sequence: Synthetic peptide
  C-term amidated
LSWAADVWAVVWDWMASGLDKDYLKPDD

SEQ ID NO: 1200 - protein, 28 aa, Artificial Sequence
  Description of Artificial Sequence: Synthetic peptide
  N-term acetylated
  C-term amidated
LSWAADVWAVVWDWMASGLDKDYLKPDD

SEQ ID NO: 1201 - protein, 28 aa, Artificial Sequence
  Description of Artificial Sequence: Synthetic peptide
  C-term amidated
LSTAADMQGVVTDGLASGLDKDYLKPDD

SEQ ID NO: 1202 - protein, 28 aa, Artificial Sequence
  Description of Artificial Sequence: Synthetic peptide
  N-term acetylated
  C-term amidated
LSTAADMQGVVTDGLASGLDKDYLKPDD

SEQ ID NO: 1203 - protein, 28 aa, Artificial Sequence
  Description of Artificial Sequence: Synthetic peptide
  C-term amidated
LSWAADMQGVVTDGLASGLDKDYLKPDD

SEQ ID NO: 1204 - protein, 28 aa, Artificial Sequence
  Description of Artificial Sequence: Synthetic peptide
  N-term acetylated
  C-term amidated
LSWAADMQGVVTDGLASGLDKDYLKPDD

SEQ ID NO: 1205 - protein, 28 aa, Artificial Sequence
  Description of Artificial Sequence: Synthetic peptide
  C-term amidated
LSTAADLQGVVTDGLASGLDKDYLKPDD

SEQ ID NO: 1206 - protein, 28 aa, Artificial Sequence
  Description of Artificial Sequence: Synthetic peptide
  N-term acetylated
  C-term amidated
LSTAADLQGVVTDGLASGLDKDYLKPDD

SEQ ID NO: 1207 - protein, 28 aa, Artificial Sequence
  Description of Artificial Sequence: Synthetic peptide
  C-term amidated
LSWAADLQGVVTDGLASGLDKDYLKPDD

SEQ ID NO: 1208 - protein, 28 aa, Artificial Sequence
  Description of Artificial Sequence: Synthetic peptide
  N-term acetylated
  C-term amidated
LSWAADLQGVVTDGLASGLDKDYLKPDD

SEQ ID NO: 1209 - protein, 28 aa, Artificial Sequence
  Description of Artificial Sequence: Synthetic peptide
  C-term amidated
LSTAADVQGVVTDGLASGLDKDYLKPDD

SEQ ID NO: 1210 - protein, 28 aa, Artificial Sequence
  Description of Artificial Sequence: Synthetic peptide
  N-term acetylated
  C-term amidated
LSTAADVQGVVTDGLASGLDKDYLKPDD

SEQ ID NO: 1211 - protein, 28 aa, Artificial Sequence
  Description of Artificial Sequence: Synthetic peptide
  C-term amidated
LSWAADVQGVVTDGLASGLDKDYLKPDD

SEQ ID NO: 1212 - protein, 28 aa, Artificial Sequence
  Description of Artificial Sequence: Synthetic peptide
  N-term acetylated
  C-term amidated
LSWAADVQGVVTDGLASGLDKDYLKPDD

SEQ ID NO: 1213 - protein, 28 aa, Artificial Sequence
  Description of Artificial Sequence: Synthetic peptide
  C-term amidated
LSTAADMWGVVTDGLASGLDKDYLKPDD

SEQ ID NO: 1214 - protein, 28 aa, Artificial Sequence
  Description of Artificial Sequence: Synthetic peptide
  N-term acetylated
  C-term amidated
LSTAADMWGVVTDGLASGLDKDYLKPDD

SEQ ID NO: 1215 - protein, 28 aa, Artificial Sequence
  Description of Artificial Sequence: Synthetic peptide
  C-term amidated
LSWAADMWGVVTDGLASGLDKDYLKPDD

SEQ ID NO: 1216 - protein, 28 aa, Artificial Sequence
  Description of Artificial Sequence: Synthetic peptide
  N-term acetylated
  C-term amidated
LSWAADMWGVVTDGLASGLDKDYLKPDD

SEQ ID NO: 1217 - protein, 28 aa, Artificial Sequence
  Description of Artificial Sequence: Synthetic peptide
  C-term amidated
LSTAADLWGVVTDGLASGLDKDYLKPDD

SEQ ID NO: 1218 - protein, 28 aa, Artificial Sequence
  Description of Artificial Sequence: Synthetic peptide
  N-term acetylated
  C-term amidated
LSTAADLWGVVTDGLASGLDKDYLKPDD

SEQ ID NO: 1219 - protein, 28 aa, Artificial Sequence
  Description of Artificial Sequence: Synthetic peptide
  C-term amidated
LSWAADLWGVVTDGLASGLDKDYLKPDD

SEQ ID NO: 1220 - protein, 28 aa, Artificial Sequence
  Description of Artificial Sequence: Synthetic peptide
  N-term acetylated
  C-term amidated
LSWAADLWGVVTDGLASGLDKDYLKPDD

SEQ ID NO: 1221 - protein, 28 aa, Artificial Sequence
  Description of Artificial Sequence: Synthetic peptide
  C-term amidated
LSTAADVWGVVTDGLASGLDKDYLKPDD

SEQ ID NO: 1222 - protein, 28 aa, Artificial Sequence
  Description of Artificial Sequence: Synthetic peptide
  N-term acetylated
  C-term amidated
LSTAADVWGVVTDGLASGLDKDYLKPDD

SEQ ID NO: 1223 - protein, 28 aa, Artificial Sequence
  Description of Artificial Sequence: Synthetic peptide
  C-term amidated
LSWAADVWGVVTDGLASGLDKDYLKPDD

SEQ ID NO: 1224 - protein, 28 aa, Artificial Sequence
  Description of Artificial Sequence: Synthetic peptide
  N-term acetylated
  C-term amidated
LSWAADVWGVVTDGLASGLDKDYLKPDD

SEQ ID NO: 1225 - protein, 28 aa, Artificial Sequence
  Description of Artificial Sequence: Synthetic peptide
  C-term amidated
LSTAADMQAVVTDGLASGLDKDYLKPDD

SEQ ID NO: 1226 - protein, 28 aa, Artificial Sequence
  Description of Artificial Sequence: Synthetic peptide
  N-term acetylated
  C-term amidated
LSTAADMQAVVTDGLASGLDKDYLKPDD

SEQ ID NO: 1227 - protein, 28 aa, Artificial Sequence
  Description of Artificial Sequence: Synthetic peptide
  C-term amidated
LSWAADMQAVVTDGLASGLDKDYLKPDD

SEQ ID NO: 1228 - protein, 28 aa, Artificial Sequence
  Description of Artificial Sequence: Synthetic peptide
  N-term acetylated
  C-term amidated
LSWAADMQAVVTDGLASGLDKDYLKPDD

SEQ ID NO: 1229 - protein, 28 aa, Artificial Sequence
  Description of Artificial Sequence: Synthetic peptide
  C-term amidated
LSTAADLQAVVTDGLASGLDKDYLKPDD

SEQ ID NO: 1230 - protein, 28 aa, Artificial Sequence
  Description of Artificial Sequence: Synthetic peptide
  N-term acetylated
  C-term amidated
LSTAADLQAVVTDGLASGLDKDYLKPDD

SEQ ID NO: 1231 - protein, 28 aa, Artificial Sequence
  Description of Artificial Sequence: Synthetic peptide
  C-term amidated
LSWAADLQAVVTDGLASGLDKDYLKPDD

SEQ ID NO: 1232 - protein, 28 aa, Artificial Sequence
  Description of Artificial Sequence: Synthetic peptide
  N-term acetylated
  C-term amidated
LSWAADLQAVVTDGLASGLDKDYLKPDD

SEQ ID NO: 1233 - protein, 28 aa, Artificial Sequence
  Description of Artificial Sequence: Synthetic peptide
  C-term amidated
LSTAADVQAVVTDGLASGLDKDYLKPDD

SEQ ID NO: 1234 - protein, 28 aa, Artificial Sequence
  Description of Artificial Sequence: Synthetic peptide
  N-term acetylated
  C-term amidated
LSTAADVQAVVTDGLASGLDKDYLKPDD

SEQ ID NO: 1235 - protein, 28 aa, Artificial Sequence
  Description of Artificial Sequence: Synthetic peptide
  C-term amidated
LSWAADVQAVVTDGLASGLDKDYLKPDD

SEQ ID NO: 1236 - protein, 28 aa, Artificial Sequence
  Description of Artificial Sequence: Synthetic peptide
  N-term acetylated
  C-term amidated
LSWAADVQAVVTDGLASGLDKDYLKPDD

SEQ ID NO: 1237 - protein, 28 aa, Artificial Sequence
  Description of Artificial Sequence: Synthetic peptide
  C-term amidated
LSTAADMWAVVTDGLASGLDKDYLKPDD

SEQ ID NO: 1238 - protein, 28 aa, Artificial Sequence
  Description of Artificial Sequence: Synthetic peptide
  N-term acetylated
  C-term amidated
LSTAADMWAVVTDGLASGLDKDYLKPDD

SEQ ID NO: 1239 - protein, 28 aa, Artificial Sequence
  Description of Artificial Sequence: Synthetic peptide
  C-term amidated
LSWAADMWAVVTDGLASGLDKDYLKPDD

SEQ ID NO: 1240 - protein, 28 aa, Artificial Sequence
  Description of Artificial Sequence: Synthetic peptide
  N-term acetylated
  C-term amidated
LSWAADMWAVVTDGLASGLDKDYLKPDD

SEQ ID NO: 1241 - protein, 28 aa, Artificial Sequence
  Description of Artificial Sequence: Synthetic peptide
  C-term amidated
LSTAADLWAVVTDGLASGLDKDYLKPDD

SEQ ID NO: 1242 - protein, 28 aa, Artificial Sequence
  Description of Artificial Sequence: Synthetic peptide
  N-term acetylated
  C-term amidated
LSTAADLWAVVTDGLASGLDKDYLKPDD

SEQ ID NO: 1243 - protein, 28 aa, Artificial Sequence
  Description of Artificial Sequence: Synthetic peptide
  C-term amidated
LSWAADLWAVVTDGLASGLDKDYLKPDD

SEQ ID NO: 1244 - protein, 28 aa, Artificial Sequence
  Description of Artificial Sequence: Synthetic peptide
  N-term acetylated
  C-term amidated
LSWAADLWAVVTDGLASGLDKDYLKPDD

SEQ ID NO: 1245 - protein, 28 aa, Artificial Sequence
  Description of Artificial Sequence: Synthetic peptide
  C-term amidated
LSTAADVWAVVTDGLASGLDKDYLKPDD

SEQ ID NO: 1246 - protein, 28 aa, Artificial Sequence
  Description of Artificial Sequence: Synthetic peptide
  N-term acetylated
  C-term amidated
LSTAADVWAVVTDGLASGLDKDYLKPDD

SEQ ID NO: 1247 - protein, 28 aa, Artificial Sequence
  Description of Artificial Sequence: Synthetic peptide
  C-term amidated
LSWAADVWAVVTDGLASGLDKDYLKPDD

SEQ ID NO: 1248 - protein, 28 aa, Artificial Sequence
  Description of Artificial Sequence: Synthetic peptide
  N-term acetylated
  C-term amidated
LSWAADVWAVVTDGLASGLDKDYLKPDD

SEQ ID NO: 1249 - protein, 28 aa, Artificial Sequence
  Description of Artificial Sequence: Synthetic peptide
  C-term amidated
LSTAADMQGVVWDGLASGLDKDYLKPDD

SEQ ID NO: 1250 - protein, 28 aa, Artificial Sequence
  Description of Artificial Sequence: Synthetic peptide
  N-term acetylated
  C-term amidated
LSTAADMQGVVWDGLASGLDKDYLKPDD

SEQ ID NO: 1251 - protein, 28 aa, Artificial Sequence
  Description of Artificial Sequence: Synthetic peptide
  C-term amidated
LSWAADMQGVVWDGLASGLDKDYLKPDD

SEQ ID NO: 1252 - protein, 28 aa, Artificial Sequence
  Description of Artificial Sequence: Synthetic peptide
  N-term acetylated
  C-term amidated
LSWAADMQGVVWDGLASGLDKDYLKPDD

SEQ ID NO: 1253 - protein, 28 aa, Artificial Sequence
  Description of Artificial Sequence: Synthetic peptide
  C-term amidated
LSTAADLQGVVWDGLASGLDKDYLKPDD

SEQ ID NO: 1254 - protein, 28 aa, Artificial Sequence
  Description of Artificial Sequence: Synthetic peptide
  N-term acetylated
  C-term amidated
LSTAADLQGVVWDGLASGLDKDYLKPDD

SEQ ID NO: 1255 - protein, 28 aa, Artificial Sequence
  Description of Artificial Sequence: Synthetic peptide
  C-term amidated
LSWAADLQGVVWDGLASGLDKDYLKPDD

SEQ ID NO: 1256 - protein, 28 aa, Artificial Sequence
  Description of Artificial Sequence: Synthetic peptide
  N-term acetylated
  C-term amidated
LSWAADLQGVVWDGLASGLDKDYLKPDD

SEQ ID NO: 1257 - protein, 28 aa, Artificial Sequence
  Description of Artificial Sequence: Synthetic peptide
  C-term amidated
LSTAADVQGVVWDGLASGLDKDYLKPDD

SEQ ID NO: 1258 - protein, 28 aa, Artificial Sequence
  Description of Artificial Sequence: Synthetic peptide
  N-term acetylated
  C-term amidated
LSTAADVQGVVWDGLASGLDKDYLKPDD

SEQ ID NO: 1259 - protein, 28 aa, Artificial Sequence
  Description of Artificial Sequence: Synthetic peptide
  C-term amidated
LSWAADVQGVVWDGLASGLDKDYLKPDD

SEQ ID NO: 1260 - protein, 28 aa, Artificial Sequence
  Description of Artificial Sequence: Synthetic peptide
  N-term acetylated
  C-term amidated
LSWAADVQGVVWDGLASGLDKDYLKPDD

SEQ ID NO: 1261 - protein, 28 aa, Artificial Sequence
  Description of Artificial Sequence: Synthetic peptide
  C-term amidated
LSTAADMWGVVWDGLASGLDKDYLKPDD

SEQ ID NO: 1262 - protein, 28 aa, Artificial Sequence
  Description of Artificial Sequence: Synthetic peptide
  N-term acetylated
  C-term amidated
LSTAADMWGVVWDGLASGLDKDYLKPDD

SEQ ID NO: 1263 - protein, 28 aa, Artificial Sequence
  Description of Artificial Sequence: Synthetic peptide
  C-term amidated
LSWAADMWGVVWDGLASGLDKDYLKPDD

SEQ ID NO: 1264 - protein, 28 aa, Artificial Sequence
  Description of Artificial Sequence: Synthetic peptide
  N-term acetylated
  C-term amidated
LSWAADMWGVVWDGLASGLDKDYLKPDD

SEQ ID NO: 1265 - protein, 28 aa, Artificial Sequence
  Description of Artificial Sequence: Synthetic peptide
  C-term amidated
LSTAADLWGVVWDGLASGLDKDYLKPDD

SEQ ID NO: 1266 - protein, 28 aa, Artificial Sequence
  Description of Artificial Sequence: Synthetic peptide
  N-term acetylated
  C-term amidated
LSTAADLWGVVWDGLASGLDKDYLKPDD

SEQ ID NO: 1267 - protein, 28 aa, Artificial Sequence
  Description of Artificial Sequence: Synthetic peptide
  C-term amidated
LSWAADLWGVVWDGLASGLDKDYLKPDD

SEQ ID NO: 1268 - protein, 28 aa, Artificial Sequence
  Description of Artificial Sequence: Synthetic peptide
  N-term acetylated
  C-term amidated
LSWAADLWGVVWDGLASGLDKDYLKPDD

SEQ ID NO: 1269 - protein, 28 aa, Artificial Sequence
  Description of Artificial Sequence: Synthetic peptide
  C-term amidated
LSTAADVWGVVWDGLASGLDKDYLKPDD

SEQ ID NO: 1270 - protein, 28 aa, Artificial Sequence
  Description of Artificial Sequence: Synthetic peptide
  N-term acetylated
  C-term amidated
LSTAADVWGVVWDGLASGLDKDYLKPDD

SEQ ID NO: 1271 - protein, 28 aa, Artificial Sequence
  Description of Artificial Sequence: Synthetic peptide
  C-term amidated
LSWAADVWGVVWDGLASGLDKDYLKPDD

SEQ ID NO: 1272 - protein, 28 aa, Artificial Sequence
  Description of Artificial Sequence: Synthetic peptide
  N-term acetylated
  C-term amidated
LSWAADVWGVVWDGLASGLDKDYLKPDD

SEQ ID NO: 1273 - protein, 28 aa, Artificial Sequence
  Description of Artificial Sequence: Synthetic peptide
  C-term amidated
LSTAADMQAVVWDGLASGLDKDYLKPDD

SEQ ID NO: 1274 - protein, 28 aa, Artificial Sequence
  Description of Artificial Sequence: Synthetic peptide
  N-term acetylated
  C-term amidated
LSTAADMQAVVWDGLASGLDKDYLKPDD

SEQ ID NO: 1275 - protein, 28 aa, Artificial Sequence
  Description of Artificial Sequence: Synthetic peptide
  C-term amidated
LSWAADMQAVVWDGLASGLDKDYLKPDD

SEQ ID NO: 1276 - protein, 28 aa, Artificial Sequence
  Description of Artificial Sequence: Synthetic peptide
  N-term acetylated
  C-term amidated
LSWAADMQAVVWDGLASGLDKDYLKPDD

SEQ ID NO: 1277 - protein, 28 aa, Artificial Sequence
  Description of Artificial Sequence: Synthetic peptide
  C-term amidated
LSTAADLQAVVWDGLASGLDKDYLKPDD

SEQ ID NO: 1278 - protein, 28 aa, Artificial Sequence
  Description of Artificial Sequence: Synthetic peptide
  N-term acetylated
  C-term amidated
LSTAADLQAVVWDGLASGLDKDYLKPDD

SEQ ID NO: 1279 - protein, 28 aa, Artificial Sequence
  Description of Artificial Sequence: Synthetic peptide
  C-term amidated
LSWAADLQAVVWDGLASGLDKDYLKPDD

SEQ ID NO: 1280 - protein, 28 aa, Artificial Sequence
  Description of Artificial Sequence: Synthetic peptide
  N-term acetylated
  C-term amidated
LSWAADLQAVVWDGLASGLDKDYLKPDD

SEQ ID NO: 1281 - protein, 28 aa, Artificial Sequence
  Description of Artificial Sequence: Synthetic peptide
  C-term amidated
LSTAADVQAVVWDGLASGLDKDYLKPDD

SEQ ID NO: 1282 - protein, 28 aa, Artificial Sequence
  Description of Artificial Sequence: Synthetic peptide
  N-term acetylated
  C-term amidated
LSTAADVQAVVWDGLASGLDKDYLKPDD

SEQ ID NO: 1283 - protein, 28 aa, Artificial Sequence
  Description of Artificial Sequence: Synthetic peptide
  C-term amidated
LSWAADVQAVVWDGLASGLDKDYLKPDD

SEQ ID NO: 1284 - protein, 28 aa, Artificial Sequence
  Description of Artificial Sequence: Synthetic peptide
  N-term acetylated
  C-term amidated
LSWAADVQAVVWDGLASGLDKDYLKPDD

SEQ ID NO: 1285 - protein, 28 aa, Artificial Sequence
  Description of Artificial Sequence: Synthetic peptide
  C-term amidated
LSTAADMWAVVWDGLASGLDKDYLKPDD

SEQ ID NO: 1286 - protein, 28 aa, Artificial Sequence
  Description of Artificial Sequence: Synthetic peptide
  N-term acetylated
  C-term amidated
LSTAADMWAVVWDGLASGLDKDYLKPDD

SEQ ID NO: 1287 - protein, 28 aa, Artificial Sequence
  Description of Artificial Sequence: Synthetic peptide
  C-term amidated
LSWAADMWAVVWDGLASGLDKDYLKPDD

SEQ ID NO: 1288 - protein, 28 aa, Artificial Sequence
  Description of Artificial Sequence: Synthetic peptide
  N-term acetylated
  C-term amidated
LSWAADMWAVVWDGLASGLDKDYLKPDD

SEQ ID NO: 1289 - protein, 28 aa, Artificial Sequence
  Description of Artificial Sequence: Synthetic peptide
  C-term amidated
LSTAADLWAVVWDGLASGLDKDYLKPDD

SEQ ID NO: 1290 - protein, 28 aa, Artificial Sequence
  Description of Artificial Sequence: Synthetic peptide
  N-term acetylated
  C-term amidated
LSTAADLWAVVWDGLASGLDKDYLKPDD

SEQ ID NO: 1291 - protein, 28 aa, Artificial Sequence
  Description of Artificial Sequence: Synthetic peptide
  C-term amidated
LSWAADLWAVVWDGLASGLDKDYLKPDD

SEQ ID NO: 1292 - protein, 28 aa, Artificial Sequence
  Description of Artificial Sequence: Synthetic peptide
  N-term acetylated
  C-term amidated
LSWAADLWAVVWDGLASGLDKDYLKPDD

SEQ ID NO: 1293 - protein, 28 aa, Artificial Sequence
  Description of Artificial Sequence: Synthetic peptide
  C-term amidated
LSTAADVWAVVWDGLASGLDKDYLKPDD

SEQ ID NO: 1294 - protein, 28 aa, Artificial Sequence
  Description of Artificial Sequence: Synthetic peptide
  N-term acetylated
  C-term amidated
LSTAADVWAVVWDGLASGLDKDYLKPDD

SEQ ID NO: 1295 - protein, 28 aa, Artificial Sequence
  Description of Artificial Sequence: Synthetic peptide
  C-term amidated
LSWAADVWAVVWDGLASGLDKDYLKPDD

SEQ ID NO: 1296 - protein, 28 aa, Artificial Sequence
  Description of Artificial Sequence: Synthetic peptide
  N-term acetylated
  C-term amidated
LSWAADVWAVVWDGLASGLDKDYLKPDD

SEQ ID NO: 1297 - protein, 28 aa, Artificial Sequence
  Description of Artificial Sequence: Synthetic peptide
  C-term amidated
LSTAADMQGVVTDTLASGLDKDYLKPDD

SEQ ID NO: 1298 - protein, 28 aa, Artificial Sequence
  Description of Artificial Sequence: Synthetic peptide
  N-term acetylated
  C-term amidated
LSTAADMQGVVTDTLASGLDKDYLKPDD

SEQ ID NO: 1299 - protein, 28 aa, Artificial Sequence
  Description of Artificial Sequence: Synthetic peptide
  C-term amidated
LSWAADMQGVVTDTLASGLDKDYLKPDD

SEQ ID NO: 1300 - protein, 28 aa, Artificial Sequence
  Description of Artificial Sequence: Synthetic peptide
  N-term acetylated
  C-term amidated
LSWAADMQGVVTDTLASGLDKDYLKPDD

SEQ ID NO: 1301 - protein, 28 aa, Artificial Sequence
  Description of Artificial Sequence: Synthetic peptide
  C-term amidated
LSTAADLQGVVTDTLASGLDKDYLKPDD

SEQ ID NO: 1302 - protein, 28 aa, Artificial Sequence
  Description of Artificial Sequence: Synthetic peptide
  N-term acetylated
  C-term amidated
LSTAADLQGVVTDTLASGLDKDYLKPDD

SEQ ID NO: 1303 - protein, 28 aa, Artificial Sequence
  Description of Artificial Sequence: Synthetic peptide
  C-term amidated
LSWAADLQGVVTDTLASGLDKDYLKPDD

SEQ ID NO: 1304 - protein, 28 aa, Artificial Sequence
  Description of Artificial Sequence: Synthetic peptide
  N-term acetylated
  C-term amidated
LSWAADLQGVVTDTLASGLDKDYLKPDD

SEQ ID NO: 1305 - protein, 28 aa, Artificial Sequence
  Description of Artificial Sequence: Synthetic peptide
  C-term amidated
LSTAADVQGVVTDTLASGLDKDYLKPDD

SEQ ID NO: 1306 - protein, 28 aa, Artificial Sequence
  Description of Artificial Sequence: Synthetic peptide
  N-term acetylated
  C-term amidated
LSTAADVQGVVTDTLASGLDKDYLKPDD

SEQ ID NO: 1307 - protein, 28 aa, Artificial Sequence
  Description of Artificial Sequence: Synthetic peptide
  C-term amidated
LSWAADVQGVVTDTLASGLDKDYLKPDD

SEQ ID NO: 1308 - protein, 28 aa, Artificial Sequence
  Description of Artificial Sequence: Synthetic peptide
  N-term acetylated
  C-term amidated
LSWAADVQGVVTDTLASGLDKDYLKPDD

SEQ ID NO: 1309 - protein, 28 aa, Artificial Sequence
  Description of Artificial Sequence: Synthetic peptide
  C-term amidated
LSTAADMWGVVTDTLASGLDKDYLKPDD

SEQ ID NO: 1310 - protein, 28 aa, Artificial Sequence
  Description of Artificial Sequence: Synthetic peptide
  N-term acetylated
  C-term amidated
LSTAADMWGVVTDTLASGLDKDYLKPDD

SEQ ID NO: 1311 - protein, 28 aa, Artificial Sequence
  Description of Artificial Sequence: Synthetic peptide
  C-term amidated
LSWAADMWGVVTDTLASGLDKDYLKPDD

SEQ ID NO: 1312 - protein, 28 aa, Artificial Sequence
  Description of Artificial Sequence: Synthetic peptide
  N-term acetylated
  C-term amidated
LSWAADMWGVVTDTLASGLDKDYLKPDD

SEQ ID NO: 1313 - protein, 28 aa, Artificial Sequence
  Description of Artificial Sequence: Synthetic peptide
  C-term amidated
LSTAADLWGVVTDTLASGLDKDYLKPDD

SEQ ID NO: 1314 - protein, 28 aa, Artificial Sequence
  Description of Artificial Sequence: Synthetic peptide
  N-term acetylated
  C-term amidated
LSTAADLWGVVTDTLASGLDKDYLKPDD

SEQ ID NO: 1315 - protein, 28 aa, Artificial Sequence
  Description of Artificial Sequence: Synthetic peptide
  C-term amidated
LSWAADLWGVVTDTLASGLDKDYLKPDD

SEQ ID NO: 1316 - protein, 28 aa, Artificial Sequence
  Description of Artificial Sequence: Synthetic peptide
  N-term acetylated
  C-term amidated
LSWAADLWGVVTDTLASGLDKDYLKPDD

SEQ ID NO: 1317 - protein, 28 aa, Artificial Sequence
  Description of Artificial Sequence: Synthetic peptide
  C-term amidated
LSTAADVWGVVTDTLASGLDKDYLKPDD

SEQ ID NO: 1318 - protein, 28 aa, Artificial Sequence
  Description of Artificial Sequence: Synthetic peptide
  N-term acetylated
  C-term amidated
LSTAADVWGVVTDTLASGLDKDYLKPDD

SEQ ID NO: 1319 - protein, 28 aa, Artificial Sequence
  Description of Artificial Sequence: Synthetic peptide
  C-term amidated
LSWAADVWGVVTDTLASGLDKDYLKPDD

SEQ ID NO: 1320 - protein, 28 aa, Artificial Sequence
  Description of Artificial Sequence: Synthetic peptide
  N-term acetylated
  C-term amidated
LSWAADVWGVVTDTLASGLDKDYLKPDD

SEQ ID NO: 1321 - protein, 28 aa, Artificial Sequence
  Description of Artificial Sequence: Synthetic peptide
  C-term amidated
LSTAADMQAVVTDTLASGLDKDYLKPDD

SEQ ID NO: 1322 - protein, 28 aa, Artificial Sequence
  Description of Artificial Sequence: Synthetic peptide
  N-term acetylated
  C-term amidated
LSTAADMQAVVTDTLASGLDKDYLKPDD

SEQ ID NO: 1323 - protein, 28 aa, Artificial Sequence
  Description of Artificial Sequence: Synthetic peptide
  C-term amidated
LSWAADMQAVVTDTLASGLDKDYLKPDD

SEQ ID NO: 1324 - protein, 28 aa, Artificial Sequence
  Description of Artificial Sequence: Synthetic peptide
  N-term acetylated
  C-term amidated
LSWAADMQAVVTDTLASGLDKDYLKPDD

SEQ ID NO: 1325 - protein, 28 aa, Artificial Sequence
  Description of Artificial Sequence: Synthetic peptide
  C-term amidated
LSTAADLQAVVTDTLASGLDKDYLKPDD

SEQ ID NO: 1326 - protein, 28 aa, Artificial Sequence
  Description of Artificial Sequence: Synthetic peptide
  N-term acetylated
  C-term amidated
LSTAADLQAVVTDTLASGLDKDYLKPDD

SEQ ID NO: 1327 - protein, 28 aa, Artificial Sequence
  Description of Artificial Sequence: Synthetic peptide
  C-term amidated
LSWAADLQAVVTDTLASGLDKDYLKPDD

SEQ ID NO: 1328 - protein, 28 aa, Artificial Sequence
  Description of Artificial Sequence: Synthetic peptide
  N-term acetylated
  C-term amidated
LSWAADLQAVVTDTLASGLDKDYLKPDD

SEQ ID NO: 1329 - protein, 28 aa, Artificial Sequence
  Description of Artificial Sequence: Synthetic peptide
  C-term amidated
LSTAADVQAVVTDTLASGLDKDYLKPDD

SEQ ID NO: 1330 - protein, 28 aa, Artificial Sequence
  Description of Artificial Sequence: Synthetic peptide
  N-term acetylated
  C-term amidated
LSTAADVQAVVTDTLASGLDKDYLKPDD

SEQ ID NO: 1331 - protein, 28 aa, Artificial Sequence
  Description of Artificial Sequence: Synthetic peptide
  C-term amidated
LSWAADVQAVVTDTLASGLDKDYLKPDD

SEQ ID NO: 1332 - protein, 28 aa, Artificial Sequence
  Description of Artificial Sequence: Synthetic peptide
  N-term acetylated
  C-term amidated
LSWAADVQAVVTDTLASGLDKDYLKPDD

SEQ ID NO: 1333 - protein, 28 aa, Artificial Sequence
  Description of Artificial Sequence: Synthetic peptide
  C-term amidated
LSTAADMWAVVTDTLASGLDKDYLKPDD

SEQ ID NO: 1334 - protein, 28 aa, Artificial Sequence
  Description of Artificial Sequence: Synthetic peptide
  N-term acetylated
  C-term amidated
LSTAADMWAVVTDTLASGLDKDYLKPDD

SEQ ID NO: 1335 - protein, 28 aa, Artificial Sequence
  Description of Artificial Sequence: Synthetic peptide
  C-term amidated
LSWAADMWAVVTDTLASGLDKDYLKPDD

SEQ ID NO: 1336 - protein, 28 aa, Artificial Sequence
  Description of Artificial Sequence: Synthetic peptide
  N-term acetylated
  C-term amidated
LSWAADMWAVVTDTLASGLDKDYLKPDD

SEQ ID NO: 1337 - protein, 28 aa, Artificial Sequence
  Description of Artificial Sequence: Synthetic peptide
  C-term amidated
LSTAADLWAVVTDTLASGLDKDYLKPDD

SEQ ID NO: 1338 - protein, 28 aa, Artificial Sequence
  Description of Artificial Sequence: Synthetic peptide
  N-term acetylated
  C-term amidated
LSTAADLWAVVTDTLASGLDKDYLKPDD

SEQ ID NO: 1339 - protein, 28 aa, Artificial Sequence
  Description of Artificial Sequence: Synthetic peptide
  C-term amidated
LSWAADLWAVVTDTLASGLDKDYLKPDD

SEQ ID NO: 1340 - protein, 28 aa, Artificial Sequence
  Description of Artificial Sequence: Synthetic peptide
  N-term acetylated
  C-term amidated
LSWAADLWAVVTDTLASGLDKDYLKPDD

SEQ ID NO: 1341 - protein, 28 aa, Artificial Sequence
  Description of Artificial Sequence: Synthetic peptide
  C-term amidated
LSTAADVWAVVTDTLASGLDKDYLKPDD

SEQ ID NO: 1342 - protein, 28 aa, Artificial Sequence
  Description of Artificial Sequence: Synthetic peptide
  N-term acetylated
  C-term amidated
LSTAADVWAVVTDTLASGLDKDYLKPDD

SEQ ID NO: 1343 - protein, 28 aa, Artificial Sequence
  Description of Artificial Sequence: Synthetic peptide
  C-term amidated
LSWAADVWAVVTDTLASGLDKDYLKPDD

SEQ ID NO: 1344 - protein, 28 aa, Artificial Sequence
  Description of Artificial Sequence: Synthetic peptide
  N-term acetylated
  C-term amidated
LSWAADVWAVVTDTLASGLDKDYLKPDD

SEQ ID NO: 1345 - protein, 28 aa, Artificial Sequence
  Description of Artificial Sequence: Synthetic peptide
  C-term amidated
LSTAADMQGVVWDTLASGLDKDYLKPDD

SEQ ID NO: 1346 - protein, 28 aa, Artificial Sequence
  Description of Artificial Sequence: Synthetic peptide
  N-term acetylated
  C-term amidated
LSTAADMQGVVWDTLASGLDKDYLKPDD

SEQ ID NO: 1347 - protein, 28 aa, Artificial Sequence
  Description of Artificial Sequence: Synthetic peptide
  C-term amidated
LSWAADMQGVVWDTLASGLDKDYLKPDD

SEQ ID NO: 1348 - protein, 28 aa, Artificial Sequence
  Description of Artificial Sequence: Synthetic peptide
  N-term acetylated
  C-term amidated
LSWAADMQGVVWDTLASGLDKDYLKPDD

SEQ ID NO: 1349 - protein, 28 aa, Artificial Sequence
  Description of Artificial Sequence: Synthetic peptide
  C-term amidated
LSTAADLQGVVWDTLASGLDKDYLKPDD

SEQ ID NO: 1350 - protein, 28 aa, Artificial Sequence
  Description of Artificial Sequence: Synthetic peptide
  N-term acetylated
  C-term amidated
LSTAADLQGVVWDTLASGLDKDYLKPDD

SEQ ID NO: 1351 - protein, 28 aa, Artificial Sequence
  Description of Artificial Sequence: Synthetic peptide
  C-term amidated
LSWAADLQGVVWDTLASGLDKDYLKPDD

SEQ ID NO: 1352 - protein, 28 aa, Artificial Sequence
  Description of Artificial Sequence: Synthetic peptide
  N-term acetylated
  C-term amidated
LSWAADLQGVVWDTLASGLDKDYLKPDD

SEQ ID NO: 1353 - protein, 28 aa, Artificial Sequence
  Description of Artificial Sequence: Synthetic peptide
  C-term amidated
LSTAADVQGVVWDTLASGLDKDYLKPDD

SEQ ID NO: 1354 - protein, 28 aa, Artificial Sequence
  Description of Artificial Sequence: Synthetic peptide
  N-term acetylated
  C-term amidated
LSTAADVQGVVWDTLASGLDKDYLKPDD

SEQ ID NO: 1355 - protein, 28 aa, Artificial Sequence
  Description of Artificial Sequence: Synthetic peptide
  C-term amidated
LSWAADVQGVVWDTLASGLDKDYLKPDD

SEQ ID NO: 1356 - protein, 28 aa, Artificial Sequence
  Description of Artificial Sequence: Synthetic peptide
  N-term acetylated
  C-term amidated
LSWAADVQGVVWDTLASGLDKDYLKPDD

SEQ ID NO: 1357 - protein, 28 aa, Artificial Sequence
  Description of Artificial Sequence: Synthetic peptide
  C-term amidated
LSTAADMWGVVWDTLASGLDKDYLKPDD

SEQ ID NO: 1358 - protein, 28 aa, Artificial Sequence
  Description of Artificial Sequence: Synthetic peptide
  N-term acetylated
  C-term amidated
LSTAADMWGVVWDTLASGLDKDYLKPDD

SEQ ID NO: 1359 - protein, 28 aa, Artificial Sequence
  Description of Artificial Sequence: Synthetic peptide
  C-term amidated
LSWAADMWGVVWDTLASGLDKDYLKPDD

SEQ ID NO: 1360 - protein, 28 aa, Artificial Sequence
  Description of Artificial Sequence: Synthetic peptide
  N-term acetylated
  C-term amidated
LSWAADMWGVVWDTLASGLDKDYLKPDD

SEQ ID NO: 1361 - protein, 28 aa, Artificial Sequence
  Description of Artificial Sequence: Synthetic peptide
  C-term amidated
LSTAADLWGVVWDTLASGLDKDYLKPDD

SEQ ID NO: 1362 - protein, 28 aa, Artificial Sequence
  Description of Artificial Sequence: Synthetic peptide
  N-term acetylated
  C-term amidated
LSTAADLWGVVWDTLASGLDKDYLKPDD

SEQ ID NO: 1363 - protein, 28 aa, Artificial Sequence
  Description of Artificial Sequence: Synthetic peptide
  C-term amidated
LSWAADLWGVVWDTLASGLDKDYLKPDD

SEQ ID NO: 1364 - protein, 28 aa, Artificial Sequence
  Description of Artificial Sequence: Synthetic peptide
  N-term acetylated
  C-term amidated
LSWAADLWGVVWDTLASGLDKDYLKPDD

SEQ ID NO: 1365 - protein, 28 aa, Artificial Sequence
  Description of Artificial Sequence: Synthetic peptide
  C-term amidated
LSTAADVWGVVWDTLASGLDKDYLKPDD

SEQ ID NO: 1366 - protein, 28 aa, Artificial Sequence
  Description of Artificial Sequence: Synthetic peptide
  N-term acetylated
  C-term amidated
LSTAADVWGVVWDTLASGLDKDYLKPDD

SEQ ID NO: 1367 - protein, 28 aa, Artificial Sequence
  Description of Artificial Sequence: Synthetic peptide
  C-term amidated
LSWAADVWGVVWDTLASGLDKDYLKPDD

SEQ ID NO: 1368 - protein, 28 aa, Artificial Sequence
  Description of Artificial Sequence: Synthetic peptide
  N-term acetylated
  C-term amidated
LSWAADVWGVVWDTLASGLDKDYLKPDD

SEQ ID NO: 1369 - protein, 28 aa, Artificial Sequence
  Description of Artificial Sequence: Synthetic peptide
  C-term amidated
LSTAADMQAVVWDTLASGLDKDYLKPDD

SEQ ID NO: 1370 - protein, 28 aa, Artificial Sequence
  Description of Artificial Sequence: Synthetic peptide
  N-term acetylated
  C-term amidated
LSTAADMQAVVWDTLASGLDKDYLKPDD

SEQ ID NO: 1371 - protein, 28 aa, Artificial Sequence
  Description of Artificial Sequence: Synthetic peptide
  C-term amidated
LSWAADMQAVVWDTLASGLDKDYLKPDD

SEQ ID NO: 1372 - protein, 28 aa, Artificial Sequence
  Description of Artificial Sequence: Synthetic peptide
  N-term acetylated
  C-term amidated
LSWAADMQAVVWDTLASGLDKDYLKPDD

SEQ ID NO: 1373 - protein, 28 aa, Artificial Sequence
  Description of Artificial Sequence: Synthetic peptide
  C-term amidated
LSTAADLQAVVWDTLASGLDKDYLKPDD

SEQ ID NO: 1374 - protein, 28 aa, Artificial Sequence
  Description of Artificial Sequence: Synthetic peptide
  N-term acetylated
  C-term amidated
LSTAADLQAVVWDTLASGLDKDYLKPDD

SEQ ID NO: 1375 - protein, 28 aa, Artificial Sequence
  Description of Artificial Sequence: Synthetic peptide
  C-term amidated
LSWAADLQAVVWDTLASGLDKDYLKPDD

SEQ ID NO: 1376 - protein, 28 aa, Artificial Sequence
  Description of Artificial Sequence: Synthetic peptide
  N-term acetylated
  C-term amidated
LSWAADLQAVVWDTLASGLDKDYLKPDD

SEQ ID NO: 1377 - protein, 28 aa, Artificial Sequence
  Description of Artificial Sequence: Synthetic peptide
  C-term amidated
LSTAADVQAVVWDTLASGLDKDYLKPDD

SEQ ID NO: 1378 - protein, 28 aa, Artificial Sequence
  Description of Artificial Sequence: Synthetic peptide
  N-term acetylated
  C-term amidated
LSTAADVQAVVWDTLASGLDKDYLKPDD

SEQ ID NO: 1379 - protein, 28 aa, Artificial Sequence
  Description of Artificial Sequence: Synthetic peptide
  C-term amidated
LSWAADVQAVVWDTLASGLDKDYLKPDD

SEQ ID NO: 1380 - protein, 28 aa, Artificial Sequence
  Description of Artificial Sequence: Synthetic peptide
  N-term acetylated
  C-term amidated
LSWAADVQAVVWDTLASGLDKDYLKPDD

SEQ ID NO: 1381 - protein, 28 aa, Artificial Sequence
  Description of Artificial Sequence: Synthetic peptide
  C-term amidated
LSTAADMWAVVWDTLASGLDKDYLKPDD

SEQ ID NO: 1382 - protein, 28 aa, Artificial Sequence
  Description of Artificial Sequence: Synthetic peptide
  N-term acetylated
  C-term amidated
LSTAADMWAVVWDTLASGLDKDYLKPDD

SEQ ID NO: 1383 - protein, 28 aa, Artificial Sequence
  Description of Artificial Sequence: Synthetic peptide
  C-term amidated
LSWAADMWAVVWDTLASGLDKDYLKPDD

SEQ ID NO: 1384 - protein, 28 aa, Artificial Sequence
  Description of Artificial Sequence: Synthetic peptide
  N-term acetylated
  C-term amidated
LSWAADMWAVVWDTLASGLDKDYLKPDD

SEQ ID NO: 1385 - protein, 28 aa, Artificial Sequence
  Description of Artificial Sequence: Synthetic peptide
  C-term amidated
LSTAADLWAVVWDTLASGLDKDYLKPDD

SEQ ID NO: 1386 - protein, 28 aa, Artificial Sequence
  Description of Artificial Sequence: Synthetic peptide
  N-term acetylated
  C-term amidated
LSTAADLWAVVWDTLASGLDKDYLKPDD

SEQ ID NO: 1387 - protein, 28 aa, Artificial Sequence
  Description of Artificial Sequence: Synthetic peptide
  C-term amidated
LSWAADLWAVVWDTLASGLDKDYLKPDD

SEQ ID NO: 1388 - protein, 28 aa, Artificial Sequence
  Description of Artificial Sequence: Synthetic peptide
  N-term acetylated
  C-term amidated
LSWAADLWAVVWDTLASGLDKDYLKPDD

SEQ ID NO: 1389 - protein, 28 aa, Artificial Sequence
  Description of Artificial Sequence: Synthetic peptide
  C-term amidated
LSTAADVWAVVWDTLASGLDKDYLKPDD

SEQ ID NO: 1390 - protein, 28 aa, Artificial Sequence
  Description of Artificial Sequence: Synthetic peptide
  N-term acetylated
  C-term amidated
LSTAADVWAVVWDTLASGLDKDYLKPDD

SEQ ID NO: 1391 - protein, 28 aa, Artificial Sequence
  Description of Artificial Sequence: Synthetic peptide
  C-term amidated
LSWAADVWAVVWDTLASGLDKDYLKPDD

SEQ ID NO: 1392 - protein, 28 aa, Artificial Sequence
  Description of Artificial Sequence: Synthetic peptide
  N-term acetylated
  C-term amidated
LSWAADVWAVVWDTLASGLDKDYLKPDD

SEQ ID NO: 1393 - protein, 28 aa, Artificial Sequence
  Description of Artificial Sequence: Synthetic peptide
  C-term amidated
LSTAADMQGVVTDWLASGLDKDYLKPDD

SEQ ID NO: 1394 - protein, 28 aa, Artificial Sequence
  Description of Artificial Sequence: Synthetic peptide
  N-term acetylated
  C-term amidated
LSTAADMQGVVTDWLASGLDKDYLKPDD

SEQ ID NO: 1395 - protein, 28 aa, Artificial Sequence
  Description of Artificial Sequence: Synthetic peptide
  Description of Artificial Sequence: Synthetic peptide
  C-term amidated
LSWAADMQGVVTDWLASGLDKDYLKPDD

SEQ ID NO: 1396 - protein, 28 aa, Artificial Sequence
  Description of Artificial Sequence: Synthetic peptide
  N-term acetylated
  C-term amidated
LSWAADMQGVVTDWLASGLDKDYLKPDD

SEQ ID NO: 1397 - protein, 28 aa, Artificial Sequence
  Description of Artificial Sequence: Synthetic peptide
  C-term amidated
LSTAADLQGVVTDWLASGLDKDYLKPDD

SEQ ID NO: 1398 - protein, 28 aa, Artificial Sequence
  Description of Artificial Sequence: Synthetic peptide
  N-term acetylated
  C-term amidated
LSTAADLQGVVTDWLASGLDKDYLKPDD

SEQ ID NO: 1399 - protein, 28 aa, Artificial Sequence
  Description of Artificial Sequence: Synthetic peptide
  C-term amidated
LSWAADLQGVVTDWLASGLDKDYLKPDD

SEQ ID NO: 1400 - protein, 28 aa, Artificial Sequence
  Description of Artificial Sequence: Synthetic peptide
  N-term acetylated
  C-term amidated
LSWAADLQGVVTDWLASGLDKDYLKPDD

SEQ ID NO: 1401 - protein, 28 aa, Artificial Sequence
  Description of Artificial Sequence: Synthetic peptide
  C-term amidated
LSTAADVQGVVTDWLASGLDKDYLKPDD

SEQ ID NO: 1402 - protein, 28 aa, Artificial Sequence
  Description of Artificial Sequence: Synthetic peptide
  N-term acetylated
  C-term amidated
LSTAADVQGVVTDWLASGLDKDYLKPDD

SEQ ID NO: 1403 - protein, 28 aa, Artificial Sequence
  Description of Artificial Sequence: Synthetic peptide
  C-term amidated
LSWAADVQGVVTDWLASGLDKDYLKPDD

SEQ ID NO: 1404 - protein, 28 aa, Artificial Sequence
  Description of Artificial Sequence: Synthetic peptide
  N-term acetylated
  C-term amidated
LSWAADVQGVVTDWLASGLDKDYLKPDD

SEQ ID NO: 1405 - protein, 28 aa, Artificial Sequence
  Description of Artificial Sequence: Synthetic peptide
  C-term amidated
LSTAADMWGVVTDWLASGLDKDYLKPDD

SEQ ID NO: 1406 - protein, 28 aa, Artificial Sequence
  Description of Artificial Sequence: Synthetic peptide
  N-term acetylated
  C-term amidated
LSTAADMWGVVTDWLASGLDKDYLKPDD

SEQ ID NO: 1407 - protein, 28 aa, Artificial Sequence
  Description of Artificial Sequence: Synthetic peptide
  C-term amidated
LSWAADMWGVVTDWLASGLDKDYLKPDD

SEQ ID NO: 1408 - protein, 28 aa, Artificial Sequence
  Description of Artificial Sequence: Synthetic peptide
  N-term acetylated
  C-term amidated
LSWAADMWGVVTDWLASGLDKDYLKPDD

SEQ ID NO: 1409 - protein, 28 aa, Artificial Sequence
  Description of Artificial Sequence: Synthetic peptide
  C-term amidated
LSTAADLWGVVTDWLASGLDKDYLKPDD

SEQ ID NO: 1410 - protein, 28 aa, Artificial Sequence
  Description of Artificial Sequence: Synthetic peptide
  N-term acetylated
  C-term amidated
LSTAADLWGVVTDWLASGLDKDYLKPDD

SEQ ID NO: 1411 - protein, 28 aa, Artificial Sequence
  Description of Artificial Sequence: Synthetic peptide
  C-term amidated
LSWAADLWGVVTDWLASGLDKDYLKPDD

SEQ ID NO: 1412 - protein, 28 aa, Artificial Sequence
  Description of Artificial Sequence: Synthetic peptide
  N-term acetylated
  C-term amidated
LSWAADLWGVVTDWLASGLDKDYLKPDD

SEQ ID NO: 1413 - protein, 28 aa, Artificial Sequence
  Description of Artificial Sequence: Synthetic peptide
  C-term amidated
LSTAADVWGVVTDWLASGLDKDYLKPDD

SEQ ID NO: 1414 - protein, 28 aa, Artificial Sequence
  Description of Artificial Sequence: Synthetic peptide
  N-term acetylated
  C-term amidated
LSTAADVWGVVTDWLASGLDKDYLKPDD

SEQ ID NO: 1415 - protein, 28 aa, Artificial Sequence
  Description of Artificial Sequence: Synthetic peptide
  C-term amidated
LSWAADVWGVVTDWLASGLDKDYLKPDD

SEQ ID NO: 1416 - protein, 28 aa, Artificial Sequence
  Description of Artificial Sequence: Synthetic peptide
  N-term acetylated
  C-term amidated
LSWAADVWGVVTDWLASGLDKDYLKPDD

SEQ ID NO: 1417 - protein, 28 aa, Artificial Sequence
  Description of Artificial Sequence: Synthetic peptide
  C-term amidated
LSTAADMQAVVTDWLASGLDKDYLKPDD

SEQ ID NO: 1418 - protein, 28 aa, Artificial Sequence
  Description of Artificial Sequence: Synthetic peptide
  N-term acetylated
  C-term amidated
LSTAADMQAVVTDWLASGLDKDYLKPDD

SEQ ID NO: 1419 - protein, 28 aa, Artificial Sequence
  Description of Artificial Sequence: Synthetic peptide
  C-term amidated
LSWAADMQAVVTDWLASGLDKDYLKPDD

SEQ ID NO: 1420 - protein, 28 aa, Artificial Sequence
  Description of Artificial Sequence: Synthetic peptide
  N-term acetylated
  C-term amidated
LSWAADMQAVVTDWLASGLDKDYLKPDD

SEQ ID NO: 1421 - protein, 28 aa, Artificial Sequence
  Description of Artificial Sequence: Synthetic peptide
  C-term amidated
LSTAADLQAVVTDWLASGLDKDYLKPDD

SEQ ID NO: 1422 - protein, 28 aa, Artificial Sequence
  Description of Artificial Sequence: Synthetic peptide
  N-term acetylated
  C-term amidated
LSTAADLQAVVTDWLASGLDKDYLKPDD

SEQ ID NO: 1423 - protein, 28 aa, Artificial Sequence
  Description of Artificial Sequence: Synthetic peptide
  C-term amidated
LSWAADLQAVVTDWLASGLDKDYLKPDD

SEQ ID NO: 1424 - protein, 28 aa, Artificial Sequence
  Description of Artificial Sequence: Synthetic peptide
  N-term acetylated
  C-term amidated
LSWAADLQAVVTDWLASGLDKDYLKPDD

SEQ ID NO: 1425 - protein, 28 aa, Artificial Sequence
  Description of Artificial Sequence: Synthetic peptide
  C-term amidated
LSTAADVQAVVTDWLASGLDKDYLKPDD

SEQ ID NO: 1426 - protein, 28 aa, Artificial Sequence
  Description of Artificial Sequence: Synthetic peptide
  N-term acetylated
  C-term amidated
LSTAADVQAVVTDWLASGLDKDYLKPDD

SEQ ID NO: 1427 - protein, 28 aa, Artificial Sequence
  Description of Artificial Sequence: Synthetic peptide
  C-term amidated
LSWAADVQAVVTDWLASGLDKDYLKPDD

SEQ ID NO: 1428 - protein, 28 aa, Artificial Sequence
  Description of Artificial Sequence: Synthetic peptide
  N-term acetylated
  C-term amidated
LSWAADVQAVVTDWLASGLDKDYLKPDD

SEQ ID NO: 1429 - protein, 28 aa, Artificial Sequence
  Description of Artificial Sequence: Synthetic peptide
  C-term amidated
LSTAADMWAVVTDWLASGLDKDYLKPDD

SEQ ID NO: 1430 - protein, 28 aa, Artificial Sequence
  Description of Artificial Sequence: Synthetic peptide
  N-term acetylated
  C-term amidated
LSTAADMWAVVTDWLASGLDKDYLKPDD

SEQ ID NO: 1431 - protein, 28 aa, Artificial Sequence
  Description of Artificial Sequence: Synthetic peptide
  C-term amidated
LSWAADMWAVVTDWLASGLDKDYLKPDD

SEQ ID NO: 1432 - protein, 28 aa, Artificial Sequence
  Description of Artificial Sequence: Synthetic peptide
  N-term acetylated
  C-term amidated
LSWAADMWAVVTDWLASGLDKDYLKPDD

SEQ ID NO: 1433 - protein, 28 aa, Artificial Sequence
  Description of Artificial Sequence: Synthetic peptide
  C-term amidated
LSTAADLWAVVTDWLASGLDKDYLKPDD

SEQ ID NO: 1434 - protein, 28 aa, Artificial Sequence
  Description of Artificial Sequence: Synthetic peptide
  N-term acetylated
  C-term amidated
LSTAADLWAVVTDWLASGLDKDYLKPDD

SEQ ID NO: 1435 - protein, 28 aa, Artificial Sequence
  Description of Artificial Sequence: Synthetic peptide
  C-term amidated
LSWAADLWAVVTDWLASGLDKDYLKPDD

SEQ ID NO: 1436 - protein, 28 aa, Artificial Sequence
  Description of Artificial Sequence: Synthetic peptide
  N-term acetylated
  C-term amidated
LSWAADLWAVVTDWLASGLDKDYLKPDD

SEQ ID NO: 1437 - protein, 28 aa, Artificial Sequence
  Description of Artificial Sequence: Synthetic peptide
  C-term amidated
LSTAADVWAVVTDWLASGLDKDYLKPDD

SEQ ID NO: 1438 - protein, 28 aa, Artificial Sequence
  Description of Artificial Sequence: Synthetic peptide
  N-term acetylated
  C-term amidated
LSTAADVWAVVTDWLASGLDKDYLKPDD

SEQ ID NO: 1439 - protein, 28 aa, Artificial Sequence
  Description of Artificial Sequence: Synthetic peptide
  C-term amidated
LSWAADVWAVVTDWLASGLDKDYLKPDD

SEQ ID NO: 1440 - protein, 28 aa, Artificial Sequence
  Description of Artificial Sequence: Synthetic peptide
  N-term acetylated
  C-term amidated
LSWAADVWAVVTDWLASGLDKDYLKPDD

SEQ ID NO: 1441 - protein, 28 aa, Artificial Sequence
  Description of Artificial Sequence: Synthetic peptide
  C-term amidated
LSTAADMQGVVWDWLASGLDKDYLKPDD

SEQ ID NO: 1442 - protein, 28 aa, Artificial Sequence
  Description of Artificial Sequence: Synthetic peptide
  N-term acetylated
  C-term amidated
LSTAADMQGVVWDWLASGLDKDYLKPDD

SEQ ID NO: 1443 - protein, 28 aa, Artificial Sequence
  Description of Artificial Sequence: Synthetic peptide
  C-term amidated
LSWAADMQGVVWDWLASGLDKDYLKPDD

SEQ ID NO: 1444 - protein, 28 aa, Artificial Sequence
  Description of Artificial Sequence: Synthetic peptide
  N-term acetylated
  C-term amidated
LSWAADMQGVVWDWLASGLDKDYLKPDD

SEQ ID NO: 1445 - protein, 28 aa, Artificial Sequence
  Description of Artificial Sequence: Synthetic peptide
  C-term amidated
LSTAADLQGVVWDWLASGLDKDYLKPDD

SEQ ID NO: 1446 - protein, 28 aa, Artificial Sequence
  Description of Artificial Sequence: Synthetic peptide
  N-term acetylated
  C-term amidated
LSTAADLQGVVWDWLASGLDKDYLKPDD

SEQ ID NO: 1447 - protein, 28 aa, Artificial Sequence
  Description of Artificial Sequence: Synthetic peptide
  C-term amidated
LSWAADLQGVVWDWLASGLDKDYLKPDD

SEQ ID NO: 1448 - protein, 28 aa, Artificial Sequence
  Description of Artificial Sequence: Synthetic peptide
  N-term acetylated
  C-term amidated
LSWAADLQGVVWDWLASGLDKDYLKPDD

SEQ ID NO: 1449 - protein, 28 aa, Artificial Sequence
  Description of Artificial Sequence: Synthetic peptide
  C-term amidated
LSTAADVQGVVWDWLASGLDKDYLKPDD

SEQ ID NO: 1450 - protein, 28 aa, Artificial Sequence
  Description of Artificial Sequence: Synthetic peptide
  N-term acetylated
  C-term amidated
LSTAADVQGVVWDWLASGLDKDYLKPDD

SEQ ID NO: 1451 - protein, 28 aa, Artificial Sequence
  Description of Artificial Sequence: Synthetic peptide
  C-term amidated
LSWAADVQGVVWDWLASGLDKDYLKPDD

SEQ ID NO: 1452 - protein, 28 aa, Artificial Sequence
  Description of Artificial Sequence: Synthetic peptide
  N-term acetylated
  C-term amidated
LSWAADVQGVVWDWLASGLDKDYLKPDD

SEQ ID NO: 1453 - protein, 28 aa, Artificial Sequence
  Description of Artificial Sequence: Synthetic peptide
  C-term amidated
LSTAADMWGVVWDWLASGLDKDYLKPDD

SEQ ID NO: 1454 - protein, 28 aa, Artificial Sequence
  Description of Artificial Sequence: Synthetic peptide
  N-term acetylated
  C-term amidated
LSTAADMWGVVWDWLASGLDKDYLKPDD

SEQ ID NO: 1455 - protein, 28 aa, Artificial Sequence
  Description of Artificial Sequence: Synthetic peptide
  C-term amidated
LSWAADMWGVVWDWLASGLDKDYLKPDD

SEQ ID NO: 1456 - protein, 28 aa, Artificial Sequence
  Description of Artificial Sequence: Synthetic peptide
  N-term acetylated
  C-term amidated
LSWAADMWGVVWDWLASGLDKDYLKPDD

SEQ ID NO: 1457 - protein, 28 aa, Artificial Sequence
  Description of Artificial Sequence: Synthetic peptide
  C-term amidated
LSTAADLWGVVWDWLASGLDKDYLKPDD

SEQ ID NO: 1458 - protein, 28 aa, Artificial Sequence
  Description of Artificial Sequence: Synthetic peptide
  N-term acetylated
  C-term amidated
LSTAADLWGVVWDWLASGLDKDYLKPDD

SEQ ID NO: 1459 - protein, 28 aa, Artificial Sequence
  Description of Artificial Sequence: Synthetic peptide
  C-term amidated
LSWAADLWGVVWDWLASGLDKDYLKPDD

SEQ ID NO: 1460 - protein, 28 aa, Artificial Sequence
  Description of Artificial Sequence: Synthetic peptide
  N-term acetylated
  C-term amidated
LSWAADLWGVVWDWLASGLDKDYLKPDD

SEQ ID NO: 1461 - protein, 28 aa, Artificial Sequence
  Description of Artificial Sequence: Synthetic peptide
  C-term amidated
LSTAADVWGVVWDWLASGLDKDYLKPDD

SEQ ID NO: 1462 - protein, 28 aa, Artificial Sequence
  Description of Artificial Sequence: Synthetic peptide
  N-term acetylated
  C-term amidated
LSTAADVWGVVWDWLASGLDKDYLKPDD

SEQ ID NO: 1463 - protein, 28 aa, Artificial Sequence
  Description of Artificial Sequence: Synthetic peptide
  C-term amidated
LSWAADVWGVVWDWLASGLDKDYLKPDD

SEQ ID NO: 1464 - protein, 28 aa, Artificial Sequence
  Description of Artificial Sequence: Synthetic peptide
  N-term acetylated
  C-term amidated
LSWAADVWGVVWDWLASGLDKDYLKPDD

SEQ ID NO: 1465 - protein, 28 aa, Artificial Sequence
  Description of Artificial Sequence: Synthetic peptide
  C-term amidated
LSTAADMQAVVWDWLASGLDKDYLKPDD

SEQ ID NO: 1466 - protein, 28 aa, Artificial Sequence
  Description of Artificial Sequence: Synthetic peptide
  N-term acetylated
  C-term amidated
LSTAADMQAVVWDWLASGLDKDYLKPDD

SEQ ID NO: 1467 - protein, 28 aa, Artificial Sequence
  Description of Artificial Sequence: Synthetic peptide
  C-term amidated
LSWAADMQAVVWDWLASGLDKDYLKPDD

SEQ ID NO: 1468 - protein, 28 aa, Artificial Sequence
  Description of Artificial Sequence: Synthetic peptide
  N-term acetylated
  C-term amidated
LSWAADMQAVVWDWLASGLDKDYLKPDD

SEQ ID NO: 1469 - protein, 28 aa, Artificial Sequence
  Description of Artificial Sequence: Synthetic peptide
  C-term amidated
LSTAADLQAVVWDWLASGLDKDYLKPDD

SEQ ID NO: 1470 - protein, 28 aa, Artificial Sequence
  Description of Artificial Sequence: Synthetic peptide
  N-term acetylated
  C-term amidated
LSTAADLQAVVWDWLASGLDKDYLKPDD

SEQ ID NO: 1471 - protein, 28 aa, Artificial Sequence
  Description of Artificial Sequence: Synthetic peptide
  C-term amidated
LSWAADLQAVVWDWLASGLDKDYLKPDD

SEQ ID NO: 1472 - protein, 28 aa, Artificial Sequence
  Description of Artificial Sequence: Synthetic peptide
  N-term acetylated
  C-term amidated
LSWAADLQAVVWDWLASGLDKDYLKPDD

SEQ ID NO: 1473 - protein, 28 aa, Artificial Sequence
  Description of Artificial Sequence: Synthetic peptide
  C-term amidated
LSTAADVQAVVWDWLASGLDKDYLKPDD

SEQ ID NO: 1474 - protein, 28 aa, Artificial Sequence
  Description of Artificial Sequence: Synthetic peptide
  N-term acetylated
  C-term amidated
LSTAADVQAVVWDWLASGLDKDYLKPDD

SEQ ID NO: 1475 - protein, 28 aa, Artificial Sequence
  Description of Artificial Sequence: Synthetic peptide
  C-term amidated
LSWAADVQAVVWDWLASGLDKDYLKPDD

SEQ ID NO: 1476 - protein, 28 aa, Artificial Sequence
  Description of Artificial Sequence: Synthetic peptide
  N-term acetylated
  C-term amidated
LSWAADVQAVVWDWLASGLDKDYLKPDD

SEQ ID NO: 1477 - protein, 28 aa, Artificial Sequence
  Description of Artificial Sequence: Synthetic peptide
  C-term amidated
LSTAADMWAVVWDWLASGLDKDYLKPDD

SEQ ID NO: 1478 - protein, 28 aa, Artificial Sequence
  Description of Artificial Sequence: Synthetic peptide
  N-term acetylated
  C-term amidated
LSTAADMWAVVWDWLASGLDKDYLKPDD

SEQ ID NO: 1479 - protein, 28 aa, Artificial Sequence
  Description of Artificial Sequence: Synthetic peptide
  C-term amidated
LSWAADMWAVVWDWLASGLDKDYLKPDD

SEQ ID NO: 1480 - protein, 28 aa, Artificial Sequence
  Description of Artificial Sequence: Synthetic peptide
  N-term acetylated
  C-term amidated
LSWAADMWAVVWDWLASGLDKDYLKPDD

SEQ ID NO: 1481 - protein, 28 aa, Artificial Sequence
  Description of Artificial Sequence: Synthetic peptide
  C-term amidated
LSTAADLWAVVWDWLASGLDKDYLKPDD

SEQ ID NO: 1482 - protein, 28 aa, Artificial Sequence
  Description of Artificial Sequence: Synthetic peptide
  N-term acetylated
  C-term amidated
LSTAADLWAVVWDWLASGLDKDYLKPDD

SEQ ID NO: 1483 - protein, 28 aa, Artificial Sequence
  Description of Artificial Sequence: Synthetic peptide
  C-term amidated
LSWAADLWAVVWDWLASGLDKDYLKPDD

SEQ ID NO: 1484 - protein, 28 aa, Artificial Sequence
  Description of Artificial Sequence: Synthetic peptide
  N-term acetylated
  C-term amidated
LSWAADLWAVVWDWLASGLDKDYLKPDD

SEQ ID NO: 1485 - protein, 28 aa, Artificial Sequence
  Description of Artificial Sequence: Synthetic peptide
  C-term amidated
LSTAADVWAVVWDWLASGLDKDYLKPDD

SEQ ID NO: 1486 - protein, 28 aa, Artificial Sequence
  Description of Artificial Sequence: Synthetic peptide
  N-term acetylated
  C-term amidated
LSTAADVWAVVWDWLASGLDKDYLKPDD

SEQ ID NO: 1487 - protein, 28 aa, Artificial Sequence
  Description of Artificial Sequence: Synthetic peptide
  C-term amidated
LSWAADVWAVVWDWLASGLDKDYLKPDD

SEQ ID NO: 1488 - protein, 28 aa, Artificial Sequence
  Description of Artificial Sequence: Synthetic peptide
  N-term acetylated
  C-term amidated
LSWAADVWAVVWDWLASGLDKDYLKPDD

SEQ ID NO: 1489 - protein, 28 aa, Artificial Sequence
  Description of Artificial Sequence: Synthetic peptide
  C-term amidated
LSTAADMQGVVTDGVASGLDKDYLKPDD

SEQ ID NO: 1490 - protein, 28 aa, Artificial Sequence
  Description of Artificial Sequence: Synthetic peptide
  N-term acetylated
  C-term amidated
LSTAADMQGVVTDGVASGLDKDYLKPDD

SEQ ID NO: 1491 - protein, 28 aa, Artificial Sequence
  Description of Artificial Sequence: Synthetic peptide
  C-term amidated
LSWAADMQGVVTDGVASGLDKDYLKPDD

SEQ ID NO: 1492 - protein, 28 aa, Artificial Sequence
  Description of Artificial Sequence: Synthetic peptide
  N-term acetylated
  C-term amidated
LSWAADMQGVVTDGVASGLDKDYLKPDD

SEQ ID NO: 1493 - protein, 28 aa, Artificial Sequence
  Description of Artificial Sequence: Synthetic peptide
  C-term amidated
LSTAADLQGVVTDGVASGLDKDYLKPDD

SEQ ID NO: 1494 - protein, 28 aa, Artificial Sequence
  Description of Artificial Sequence: Synthetic peptide
  N-term acetylated
  C-term amidated
LSTAADLQGVVTDGVASGLDKDYLKPDD

SEQ ID NO: 1495 - protein, 28 aa, Artificial Sequence
  Description of Artificial Sequence: Synthetic peptide
  C-term amidated
LSWAADLQGVVTDGVASGLDKDYLKPDD

SEQ ID NO: 1496 - protein, 28 aa, Artificial Sequence
  Description of Artificial Sequence: Synthetic peptide
  N-term acetylated
  C-term amidated
LSWAADLQGVVTDGVASGLDKDYLKPDD

SEQ ID NO: 1497 - protein, 28 aa, Artificial Sequence
  Description of Artificial Sequence: Synthetic peptide
  C-term amidated
LSTAADVQGVVTDGVASGLDKDYLKPDD

SEQ ID NO: 1498 - protein, 28 aa, Artificial Sequence
  Description of Artificial Sequence: Synthetic peptide
  N-term acetylated
  C-term amidated
LSTAADVQGVVTDGVASGLDKDYLKPDD

SEQ ID NO: 1499 - protein, 28 aa, Artificial Sequence
  Description of Artificial Sequence: Synthetic peptide
  C-term amidated
LSWAADVQGVVTDGVASGLDKDYLKPDD

SEQ ID NO: 1500 - protein, 28 aa, Artificial Sequence
  Description of Artificial Sequence: Synthetic peptide
  N-term acetylated
  C-term amidated
LSWAADVQGVVTDGVASGLDKDYLKPDD

SEQ ID NO: 1501 - protein, 28 aa, Artificial Sequence
  Description of Artificial Sequence: Synthetic peptide
  C-term amidated
LSTAADMWGVVTDGVASGLDKDYLKPDD

SEQ ID NO: 1502 - protein, 28 aa, Artificial Sequence
  Description of Artificial Sequence: Synthetic peptide
  N-term acetylated
  C-term amidated
LSTAADMWGVVTDGVASGLDKDYLKPDD

SEQ ID NO: 1503 - protein, 28 aa, Artificial Sequence
  Description of Artificial Sequence: Synthetic peptide
  C-term amidated
LSWAADMWGVVTDGVASGLDKDYLKPDD

SEQ ID NO: 1504 - protein, 28 aa, Artificial Sequence
  Description of Artificial Sequence: Synthetic peptide
  N-term acetylated
  C-term amidated
LSWAADMWGVVTDGVASGLDKDYLKPDD

SEQ ID NO: 1505 - protein, 28 aa, Artificial Sequence
  Description of Artificial Sequence: Synthetic peptide
  C-term amidated
LSTAADLWGVVTDGVASGLDKDYLKPDD

SEQ ID NO: 1506 - protein, 28 aa, Artificial Sequence
  Description of Artificial Sequence: Synthetic peptide
  N-term acetylated
  C-term amidated
LSTAADLWGVVTDGVASGLDKDYLKPDD

SEQ ID NO: 1507 - protein, 28 aa, Artificial Sequence
  Description of Artificial Sequence: Synthetic peptide
  C-term amidated
LSWAADLWGVVTDGVASGLDKDYLKPDD

SEQ ID NO: 1508 - protein, 28 aa, Artificial Sequence
  Description of Artificial Sequence: Synthetic peptide
  N-term acetylated
  C-term amidated
LSWAADLWGVVTDGVASGLDKDYLKPDD

SEQ ID NO: 1509 - protein, 28 aa, Artificial Sequence
  Description of Artificial Sequence: Synthetic peptide
  C-term amidated
LSTAADVWGVVTDGVASGLDKDYLKPDD

SEQ ID NO: 1510 - protein, 28 aa, Artificial Sequence
  Description of Artificial Sequence: Synthetic peptide
  N-term acetylated
  C-term amidated
LSTAADVWGVVTDGVASGLDKDYLKPDD

SEQ ID NO: 1511 - protein, 28 aa, Artificial Sequence
  Description of Artificial Sequence: Synthetic peptide
  C-term amidated
LSWAADVWGVVTDGVASGLDKDYLKPDD

SEQ ID NO: 1512 - protein, 28 aa, Artificial Sequence
  Description of Artificial Sequence: Synthetic peptide
  N-term acetylated
  C-term amidated
LSWAADVWGVVTDGVASGLDKDYLKPDD

SEQ ID NO: 1513 - protein, 28 aa, Artificial Sequence
  Description of Artificial Sequence: Synthetic peptide
  C-term amidated
LSTAADMQAVVTDGVASGLDKDYLKPDD

SEQ ID NO: 1514 - protein, 28 aa, Artificial Sequence
  Description of Artificial Sequence: Synthetic peptide
  N-term acetylated
  C-term amidated
LSTAADMQAVVTDGVASGLDKDYLKPDD

SEQ ID NO: 1515 - protein, 28 aa, Artificial Sequence
  Description of Artificial Sequence: Synthetic peptide
  C-term amidated
LSWAADMQAVVTDGVASGLDKDYLKPDD

SEQ ID NO: 1516 - protein, 28 aa, Artificial Sequence
  Description of Artificial Sequence: Synthetic peptide
  N-term acetylated
  C-term amidated
LSWAADMQAVVTDGVASGLDKDYLKPDD

SEQ ID NO: 1517 - protein, 28 aa, Artificial Sequence
  Description of Artificial Sequence: Synthetic peptide
  C-term amidated
LSTAADLQAVVTDGVASGLDKDYLKPDD

SEQ ID NO: 1518 - protein, 28 aa, Artificial Sequence
  Description of Artificial Sequence: Synthetic peptide
  N-term acetylated
  C-term amidated
LSTAADLQAVVTDGVASGLDKDYLKPDD

SEQ ID NO: 1519 - protein, 28 aa, Artificial Sequence
  Description of Artificial Sequence: Synthetic peptide
  C-term amidated
LSWAADLQAVVTDGVASGLDKDYLKPDD

SEQ ID NO: 1520 - protein, 28 aa, Artificial Sequence
  Description of Artificial Sequence: Synthetic peptide
  N-term acetylated
  C-term amidated
LSWAADLQAVVTDGVASGLDKDYLKPDD

SEQ ID NO: 1521 - protein, 28 aa, Artificial Sequence
  Description of Artificial Sequence: Synthetic peptide
  C-term amidated
LSTAADVQAVVTDGVASGLDKDYLKPDD

SEQ ID NO: 1522 - protein, 28 aa, Artificial Sequence
  Description of Artificial Sequence: Synthetic peptide
  N-term acetylated
  C-term amidated
LSTAADVQAVVTDGVASGLDKDYLKPDD

SEQ ID NO: 1523 - protein, 28 aa, Artificial Sequence
  Description of Artificial Sequence: Synthetic peptide
  C-term amidated
LSWAADVQAVVTDGVASGLDKDYLKPDD

SEQ ID NO: 1524 - protein, 28 aa, Artificial Sequence
  Description of Artificial Sequence: Synthetic peptide
  N-term acetylated
  C-term amidated
LSWAADVQAVVTDGVASGLDKDYLKPDD

SEQ ID NO: 1525 - protein, 28 aa, Artificial Sequence
  Description of Artificial Sequence: Synthetic peptide
  C-term amidated
LSTAADMWAVVTDGVASGLDKDYLKPDD

SEQ ID NO: 1526 - protein, 28 aa, Artificial Sequence
  Description of Artificial Sequence: Synthetic peptide
  N-term acetylated
  C-term amidated
LSTAADMWAVVTDGVASGLDKDYLKPDD

SEQ ID NO: 1527 - protein, 28 aa, Artificial Sequence
  Description of Artificial Sequence: Synthetic peptide
  C-term amidated
LSWAADMWAVVTDGVASGLDKDYLKPDD

SEQ ID NO: 1528 - protein, 28 aa, Artificial Sequence
  Description of Artificial Sequence: Synthetic peptide
  N-term acetylated
  C-term amidated
LSWAADMWAVVTDGVASGLDKDYLKPDD

SEQ ID NO: 1529 - protein, 28 aa, Artificial Sequence
  Description of Artificial Sequence: Synthetic peptide
  C-term amidated
LSTAADLWAVVTDGVASGLDKDYLKPDD

SEQ ID NO: 1530 - protein, 28 aa, Artificial Sequence
  Description of Artificial Sequence: Synthetic peptide
  N-term acetylated
  C-term amidated
LSTAADLWAVVTDGVASGLDKDYLKPDD

SEQ ID NO: 1531 - protein, 28 aa, Artificial Sequence
  Description of Artificial Sequence: Synthetic peptide
  C-term amidated
LSWAADLWAVVTDGVASGLDKDYLKPDD

SEQ ID NO: 1532 - protein, 28 aa, Artificial Sequence
  Description of Artificial Sequence: Synthetic peptide
  N-term acetylated
  C-term amidated
LSWAADLWAVVTDGVASGLDKDYLKPDD

SEQ ID NO: 1533 - protein, 28 aa, Artificial Sequence
  Description of Artificial Sequence: Synthetic peptide
  C-term amidated
LSTAADVWAVVTDGVASGLDKDYLKPDD

SEQ ID NO: 1534 - protein, 28 aa, Artificial Sequence
  Description of Artificial Sequence: Synthetic peptide
  N-term acetylated
  C-term amidated
LSTAADVWAVVTDGVASGLDKDYLKPDD

SEQ ID NO: 1535 - protein, 28 aa, Artificial Sequence
  Description of Artificial Sequence: Synthetic peptide
  C-term amidated
LSWAADVWAVVTDGVASGLDKDYLKPDD

SEQ ID NO: 1536 - protein, 28 aa, Artificial Sequence
  Description of Artificial Sequence: Synthetic peptide
  N-term acetylated
  C-term amidated
LSWAADVWAVVTDGVASGLDKDYLKPDD

SEQ ID NO: 1537 - protein, 28 aa, Artificial Sequence
  Description of Artificial Sequence: Synthetic peptide
  C-term amidated
LSTAADMQGVVWDGVASGLDKDYLKPDD

SEQ ID NO: 1538 - protein, 28 aa, Artificial Sequence
  Description of Artificial Sequence: Synthetic peptide
  N-term acetylated
  C-term amidated
LSTAADMQGVVWDGVASGLDKDYLKPDD

SEQ ID NO: 1539 - protein, 28 aa, Artificial Sequence
  Description of Artificial Sequence: Synthetic peptide
  C-term amidated
LSWAADMQGVVWDGVASGLDKDYLKPDD

SEQ ID NO: 1540 - protein, 28 aa, Artificial Sequence
  Description of Artificial Sequence: Synthetic peptide
  N-term acetylated
  C-term amidated
LSWAADMQGVVWDGVASGLDKDYLKPDD

SEQ ID NO: 1541 - protein, 28 aa, Artificial Sequence
  Description of Artificial Sequence: Synthetic peptide
  C-term amidated
LSTAADLQGVVWDGVASGLDKDYLKPDD

SEQ ID NO: 1542 - protein, 28 aa, Artificial Sequence
  Description of Artificial Sequence: Synthetic peptide
  N-term acetylated
  C-term amidated
LSTAADLQGVVWDGVASGLDKDYLKPDD

SEQ ID NO: 1543 - protein, 28 aa, Artificial Sequence
  Description of Artificial Sequence: Synthetic peptide
  C-term amidated
LSWAADLQGVVWDGVASGLDKDYLKPDD

SEQ ID NO: 1544 - protein, 28 aa, Artificial Sequence
  Description of Artificial Sequence: Synthetic peptide
  N-term acetylated
  C-term amidated
LSWAADLQGVVWDGVASGLDKDYLKPDD

SEQ ID NO: 1545 - protein, 28 aa, Artificial Sequence
  Description of Artificial Sequence: Synthetic peptide
  C-term amidated
LSTAADVQGVVWDGVASGLDKDYLKPDD

SEQ ID NO: 1546 - protein, 28 aa, Artificial Sequence
  Description of Artificial Sequence: Synthetic peptide
  N-term acetylated
  C-term amidated
LSTAADVQGVVWDGVASGLDKDYLKPDD

SEQ ID NO: 1547 - protein, 28 aa, Artificial Sequence
  Description of Artificial Sequence: Synthetic peptide
  C-term amidated
LSWAADVQGVVWDGVASGLDKDYLKPDD

SEQ ID NO: 1548 - protein, 28 aa, Artificial Sequence
  Description of Artificial Sequence: Synthetic peptide
  N-term acetylated
  C-term amidated
LSWAADVQGVVWDGVASGLDKDYLKPDD

SEQ ID NO: 1549 - protein, 28 aa, Artificial Sequence
  Description of Artificial Sequence: Synthetic peptide
  C-term amidated
LSTAADMWGVVWDGVASGLDKDYLKPDD

SEQ ID NO: 1550 - protein, 28 aa, Artificial Sequence
  Description of Artificial Sequence: Synthetic peptide
  N-term acetylated
  C-term amidated
LSTAADMWGVVWDGVASGLDKDYLKPDD

SEQ ID NO: 1551 - protein, 28 aa, Artificial Sequence
  Description of Artificial Sequence: Synthetic peptide
  C-term amidated
LSWAADMWGVVWDGVASGLDKDYLKPDD

SEQ ID NO: 1552 - protein, 28 aa, Artificial Sequence
  Description of Artificial Sequence: Synthetic peptide
  N-term acetylated
  C-term amidated
LSWAADMWGVVWDGVASGLDKDYLKPDD

SEQ ID NO: 1553 - protein, 28 aa, Artificial Sequence
  Description of Artificial Sequence: Synthetic peptide
  C-term amidated
LSTAADLWGVVWDGVASGLDKDYLKPDD

SEQ ID NO: 1554 - protein, 28 aa, Artificial Sequence
  Description of Artificial Sequence: Synthetic peptide
  N-term acetylated
  C-term amidated
LSTAADLWGVVWDGVASGLDKDYLKPDD

SEQ ID NO: 1555 - protein, 28 aa, Artificial Sequence
  Description of Artificial Sequence: Synthetic peptide
  C-term amidated
LSWAADLWGVVWDGVASGLDKDYLKPDD

SEQ ID NO: 1556 - protein, 28 aa, Artificial Sequence
  Description of Artificial Sequence: Synthetic peptide
  N-term acetylated
  C-term amidated
LSWAADLWGVVWDGVASGLDKDYLKPDD

SEQ ID NO: 1557 - protein, 28 aa, Artificial Sequence
  Description of Artificial Sequence: Synthetic peptide
  C-term amidated
LSTAADVWGVVWDGVASGLDKDYLKPDD

SEQ ID NO: 1558 - protein, 28 aa, Artificial Sequence
  Description of Artificial Sequence: Synthetic peptide
  N-term acetylated
  C-term amidated
LSTAADVWGVVWDGVASGLDKDYLKPDD

SEQ ID NO: 1559 - protein, 28 aa, Artificial Sequence
  Description of Artificial Sequence: Synthetic peptide
  C-term amidated
LSWAADVWGVVWDGVASGLDKDYLKPDD

SEQ ID NO: 1560 - protein, 28 aa, Artificial Sequence
  Description of Artificial Sequence: Synthetic peptide
  N-term acetylated
  C-term amidated
LSWAADVWGVVWDGVASGLDKDYLKPDD

SEQ ID NO: 1561 - protein, 28 aa, Artificial Sequence
  Description of Artificial Sequence: Synthetic peptide
  C-term amidated
LSTAADMQAVVWDGVASGLDKDYLKPDD

SEQ ID NO: 1562 - protein, 28 aa, Artificial Sequence
  Description of Artificial Sequence: Synthetic peptide
  N-term acetylated
  C-term amidated
LSTAADMQAVVWDGVASGLDKDYLKPDD

SEQ ID NO: 1563 - protein, 28 aa, Artificial Sequence
  Description of Artificial Sequence: Synthetic peptide
  C-term amidated
LSWAADMQAVVWDGVASGLDKDYLKPDD

SEQ ID NO: 1564 - protein, 28 aa, Artificial Sequence
  Description of Artificial Sequence: Synthetic peptide
  N-term acetylated
  C-term amidated
LSWAADMQAVVWDGVASGLDKDYLKPDD

SEQ ID NO: 1565 - protein, 28 aa, Artificial Sequence
  Description of Artificial Sequence: Synthetic peptide
  C-term amidated
LSTAADLQAVVWDGVASGLDKDYLKPDD

SEQ ID NO: 1566 - protein, 28 aa, Artificial Sequence
  Description of Artificial Sequence: Synthetic peptide
  N-term acetylated
  C-term amidated
LSTAADLQAVVWDGVASGLDKDYLKPDD

SEQ ID NO: 1567 - protein, 28 aa, Artificial Sequence
  Description of Artificial Sequence: Synthetic peptide
  C-term amidated
LSWAADLQAVVWDGVASGLDKDYLKPDD

SEQ ID NO: 1568 - protein, 28 aa, Artificial Sequence
  Description of Artificial Sequence: Synthetic peptide
  N-term acetylated
  C-term amidated
LSWAADLQAVVWDGVASGLDKDYLKPDD

SEQ ID NO: 1569 - protein, 28 aa, Artificial Sequence
  Description of Artificial Sequence: Synthetic peptide
  C-term amidated
LSTAADVQAVVWDGVASGLDKDYLKPDD

SEQ ID NO: 1570 - protein, 28 aa, Artificial Sequence
  Description of Artificial Sequence: Synthetic peptide
  N-term acetylated
  C-term amidated
LSTAADVQAVVWDGVASGLDKDYLKPDD

SEQ ID NO: 1571 - protein, 28 aa, Artificial Sequence
  Description of Artificial Sequence: Synthetic peptide
  C-term amidated
LSWAADVQAVVWDGVASGLDKDYLKPDD

SEQ ID NO: 1572 - protein, 28 aa, Artificial Sequence
  Description of Artificial Sequence: Synthetic peptide
  N-term acetylated
  C-term amidated
LSWAADVQAVVWDGVASGLDKDYLKPDD

SEQ ID NO: 1573 - protein, 28 aa, Artificial Sequence
  Description of Artificial Sequence: Synthetic peptide
  C-term amidated
LSTAADMWAVVWDGVASGLDKDYLKPDD

SEQ ID NO: 1574 - protein, 28 aa, Artificial Sequence
  Description of Artificial Sequence: Synthetic peptide
  N-term acetylated
  C-term amidated
LSTAADMWAVVWDGVASGLDKDYLKPDD

SEQ ID NO: 1575 - protein, 28 aa, Artificial Sequence
  Description of Artificial Sequence: Synthetic peptide
  C-term amidated
LSWAADMWAVVWDGVASGLDKDYLKPDD

SEQ ID NO: 1576 - protein, 28 aa, Artificial Sequence
  Description of Artificial Sequence: Synthetic peptide
  N-term acetylated
  C-term amidated
LSWAADMWAVVWDGVASGLDKDYLKPDD

SEQ ID NO: 1577 - protein, 28 aa, Artificial Sequence
  Description of Artificial Sequence: Synthetic peptide
  C-term amidated
LSTAADLWAVVWDGVASGLDKDYLKPDD

SEQ ID NO: 1578 - protein, 28 aa, Artificial Sequence
  Description of Artificial Sequence: Synthetic peptide
  N-term acetylated
  C-term amidated
LSTAADLWAVVWDGVASGLDKDYLKPDD

SEQ ID NO: 1579 - protein, 28 aa, Artificial Sequence
  Description of Artificial Sequence: Synthetic peptide
  C-term amidated
LSWAADLWAVVWDGVASGLDKDYLKPDD

SEQ ID NO: 1580 - protein, 28 aa, Artificial Sequence
  Description of Artificial Sequence: Synthetic peptide
  N-term acetylated
  C-term amidated
LSWAADLWAVVWDGVASGLDKDYLKPDD

SEQ ID NO: 1581 - protein, 28 aa, Artificial Sequence
  Description of Artificial Sequence: Synthetic peptide
  C-term amidated
LSTAADVWAVVWDGVASGLDKDYLKPDD

SEQ ID NO: 1582 - protein, 28 aa, Artificial Sequence
  Description of Artificial Sequence: Synthetic peptide
  N-term acetylated
  C-term amidated
LSTAADVWAVVWDGVASGLDKDYLKPDD

SEQ ID NO: 1583 - protein, 28 aa, Artificial Sequence
  Description of Artificial Sequence: Synthetic peptide
  C-term amidated
LSWAADVWAVVWDGVASGLDKDYLKPDD

SEQ ID NO: 1584 - protein, 28 aa, Artificial Sequence
  Description of Artificial Sequence: Synthetic peptide
  N-term acetylated
  C-term amidated
LSWAADVWAVVWDGVASGLDKDYLKPDD

SEQ ID NO: 1585 - protein, 28 aa, Artificial Sequence
  Description of Artificial Sequence: Synthetic peptide
  C-term amidated
LSTAADMQGVVTDTVASGLDKDYLKPDD

SEQ ID NO: 1586 - protein, 28 aa, Artificial Sequence
  Description of Artificial Sequence: Synthetic peptide
  N-term acetylated
  C-term amidated
LSTAADMQGVVTDTVASGLDKDYLKPDD

SEQ ID NO: 1587 - protein, 28 aa, Artificial Sequence
  Description of Artificial Sequence: Synthetic peptide
  C-term amidated
LSWAADMQGVVTDTVASGLDKDYLKPDD

SEQ ID NO: 1588 - protein, 28 aa, Artificial Sequence
  Description of Artificial Sequence: Synthetic peptide
  N-term acetylated
  C-term amidated
LSWAADMQGVVTDTVASGLDKDYLKPDD

SEQ ID NO: 1589 - protein, 28 aa, Artificial Sequence
  Description of Artificial Sequence: Synthetic peptide
  C-term amidated
LSTAADLQGVVTDTVASGLDKDYLKPDD

SEQ ID NO: 1590 - protein, 28 aa, Artificial Sequence
  Description of Artificial Sequence: Synthetic peptide
  N-term acetylated
  C-term amidated
LSTAADLQGVVTDTVASGLDKDYLKPDD

SEQ ID NO: 1591 - protein, 28 aa, Artificial Sequence
  Description of Artificial Sequence: Synthetic peptide
  C-term amidated
LSWAADLQGVVTDTVASGLDKDYLKPDD

SEQ ID NO: 1592 - protein, 28 aa, Artificial Sequence
  Description of Artificial Sequence: Synthetic peptide
  N-term acetylated
  C-term amidated
LSWAADLQGVVTDTVASGLDKDYLKPDD

SEQ ID NO: 1593 - protein, 28 aa, Artificial Sequence
  Description of Artificial Sequence: Synthetic peptide
  C-term amidated
LSTAADVQGVVTDTVASGLDKDYLKPDD

SEQ ID NO: 1594 - protein, 28 aa, Artificial Sequence
  Description of Artificial Sequence: Synthetic peptide
  N-term acetylated
  C-term amidated
LSTAADVQGVVTDTVASGLDKDYLKPDD

SEQ ID NO: 1595 - protein, 28 aa, Artificial Sequence
  Description of Artificial Sequence: Synthetic peptide
  C-term amidated
LSWAADVQGVVTDTVASGLDKDYLKPDD

SEQ ID NO: 1596 - protein, 28 aa, Artificial Sequence
  Description of Artificial Sequence: Synthetic peptide
  N-term acetylated
  C-term amidated
LSWAADVQGVVTDTVASGLDKDYLKPDD

SEQ ID NO: 1597 - protein, 28 aa, Artificial Sequence
  Description of Artificial Sequence: Synthetic peptide
  C-term amidated
LSTAADMWGVVTDTVASGLDKDYLKPDD

SEQ ID NO: 1598 - protein, 28 aa, Artificial Sequence
  Description of Artificial Sequence: Synthetic peptide
  N-term acetylated
  C-term amidated
LSTAADMWGVVTDTVASGLDKDYLKPDD

SEQ ID NO: 1599 - protein, 28 aa, Artificial Sequence
  Description of Artificial Sequence: Synthetic peptide
  C-term amidated
LSWAADMWGVVTDTVASGLDKDYLKPDD

SEQ ID NO: 1600 - protein, 28 aa, Artificial Sequence
  Description of Artificial Sequence: Synthetic peptide
  N-term acetylated
  C-term amidated
LSWAADMWGVVTDTVASGLDKDYLKPDD

SEQ ID NO: 1601 - protein, 28 aa, Artificial Sequence
  Description of Artificial Sequence: Synthetic peptide
  C-term amidated
LSTAADLWGVVTDTVASGLDKDYLKPDD

SEQ ID NO: 1602 - protein, 28 aa, Artificial Sequence
  Description of Artificial Sequence: Synthetic peptide
  N-term acetylated
  C-term amidated
LSTAADLWGVVTDTVASGLDKDYLKPDD

SEQ ID NO: 1603 - protein, 28 aa, Artificial Sequence
  Description of Artificial Sequence: Synthetic peptide
  C-term amidated
LSWAADLWGVVTDTVASGLDKDYLKPDD

SEQ ID NO: 1604 - protein, 28 aa, Artificial Sequence
  Description of Artificial Sequence: Synthetic peptide
  N-term acetylated
  C-term amidated
LSWAADLWGVVTDTVASGLDKDYLKPDD

SEQ ID NO: 1605 - protein, 28 aa, Artificial Sequence
  Description of Artificial Sequence: Synthetic peptide
  C-term amidated
LSTAADVWGVVTDTVASGLDKDYLKPDD

SEQ ID NO: 1606 - protein, 28 aa, Artificial Sequence
  Description of Artificial Sequence: Synthetic peptide
  N-term acetylated
  C-term amidated
LSTAADVWGVVTDTVASGLDKDYLKPDD

SEQ ID NO: 1607 - protein, 28 aa, Artificial Sequence
  Description of Artificial Sequence: Synthetic peptide
  C-term amidated
LSWAADVWGVVTDTVASGLDKDYLKPDD

SEQ ID NO: 1608 - protein, 28 aa, Artificial Sequence
  Description of Artificial Sequence: Synthetic peptide
  N-term acetylated
  C-term amidated
LSWAADVWGVVTDTVASGLDKDYLKPDD

SEQ ID NO: 1609 - protein, 28 aa, Artificial Sequence
  Description of Artificial Sequence: Synthetic peptide
  C-term amidated
LSTAADMQAVVTDTVASGLDKDYLKPDD

SEQ ID NO: 1610 - protein, 28 aa, Artificial Sequence
  Description of Artificial Sequence: Synthetic peptide
  N-term acetylated
  C-term amidated
LSTAADMQAVVTDTVASGLDKDYLKPDD

SEQ ID NO: 1611 - protein, 28 aa, Artificial Sequence
  Description of Artificial Sequence: Synthetic peptide
  C-term amidated
LSWAADMQAVVTDTVASGLDKDYLKPDD

SEQ ID NO: 1612 - protein, 28 aa, Artificial Sequence
  Description of Artificial Sequence: Synthetic peptide
  N-term acetylated
  C-term amidated
LSWAADMQAVVTDTVASGLDKDYLKPDD

SEQ ID NO: 1613 - protein, 28 aa, Artificial Sequence
  Description of Artificial Sequence: Synthetic peptide
  C-term amidated
LSTAADLQAVVTDTVASGLDKDYLKPDD

SEQ ID NO: 1614 - protein, 28 aa, Artificial Sequence
  Description of Artificial Sequence: Synthetic peptide
  N-term acetylated
  C-term amidated
LSTAADLQAVVTDTVASGLDKDYLKPDD

SEQ ID NO: 1615 - protein, 28 aa, Artificial Sequence
  Description of Artificial Sequence: Synthetic peptide
  C-term amidated
LSWAADLQAVVTDTVASGLDKDYLKPDD

SEQ ID NO: 1616 - protein, 28 aa, Artificial Sequence
  Description of Artificial Sequence: Synthetic peptide
  N-term acetylated
  C-term amidated
LSWAADLQAVVTDTVASGLDKDYLKPDD

SEQ ID NO: 1617 - protein, 28 aa, Artificial Sequence
  Description of Artificial Sequence: Synthetic peptide
  C-term amidated
LSTAADVQAVVTDTVASGLDKDYLKPDD

SEQ ID NO: 1618 - protein, 28 aa, Artificial Sequence
  Description of Artificial Sequence: Synthetic peptide
  N-term acetylated
  C-term amidated
LSTAADVQAVVTDTVASGLDKDYLKPDD

SEQ ID NO: 1619 - protein, 28 aa, Artificial Sequence
  Description of Artificial Sequence: Synthetic peptide
  C-term amidated
LSWAADVQAVVTDTVASGLDKDYLKPDD

SEQ ID NO: 1620 - protein, 28 aa, Artificial Sequence
  Description of Artificial Sequence: Synthetic peptide
  N-term acetylated
  C-term amidated
LSWAADVQAVVTDTVASGLDKDYLKPDD

SEQ ID NO: 1621 - protein, 28 aa, Artificial Sequence
  Description of Artificial Sequence: Synthetic peptide
  C-term amidated
LSTAADMWAVVTDTVASGLDKDYLKPDD

SEQ ID NO: 1622 - protein, 28 aa, Artificial Sequence
  Description of Artificial Sequence: Synthetic peptide
  N-term acetylated
  C-term amidated
LSTAADMWAVVTDTVASGLDKDYLKPDD

SEQ ID NO: 1623 - protein, 28 aa, Artificial Sequence
  Description of Artificial Sequence: Synthetic peptide
  C-term amidated
LSWAADMWAVVTDTVASGLDKDYLKPDD

SEQ ID NO: 1624 - protein, 28 aa, Artificial Sequence
  Description of Artificial Sequence: Synthetic peptide
  N-term acetylated
  C-term amidated
LSWAADMWAVVTDTVASGLDKDYLKPDD

SEQ ID NO: 1625 - protein, 28 aa, Artificial Sequence
  Description of Artificial Sequence: Synthetic peptide
  C-term amidated
LSTAADLWAVVTDTVASGLDKDYLKPDD

SEQ ID NO: 1626 - protein, 28 aa, Artificial Sequence
  Description of Artificial Sequence: Synthetic peptide
  N-term acetylated
  C-term amidated
LSTAADLWAVVTDTVASGLDKDYLKPDD

SEQ ID NO: 1627 - protein, 28 aa, Artificial Sequence
  Description of Artificial Sequence: Synthetic peptide
  C-term amidated
LSWAADLWAVVTDTVASGLDKDYLKPDD

SEQ ID NO: 1628 - protein, 28 aa, Artificial Sequence
  Description of Artificial Sequence: Synthetic peptide
  N-term acetylated
  C-term amidated
LSWAADLWAVVTDTVASGLDKDYLKPDD

SEQ ID NO: 1629 - protein, 28 aa, Artificial Sequence
  Description of Artificial Sequence: Synthetic peptide
  C-term amidated
LSTAADVWAVVTDTVASGLDKDYLKPDD

SEQ ID NO: 1630 - protein, 28 aa, Artificial Sequence
  Description of Artificial Sequence: Synthetic peptide
  N-term acetylated
  C-term amidated
LSTAADVWAVVTDTVASGLDKDYLKPDD

SEQ ID NO: 1631 - protein, 28 aa, Artificial Sequence
  Description of Artificial Sequence: Synthetic peptide
  C-term amidated
LSWAADVWAVVTDTVASGLDKDYLKPDD

SEQ ID NO: 1632 - protein, 28 aa, Artificial Sequence
  Description of Artificial Sequence: Synthetic peptide
  N-term acetylated
  C-term amidated
LSWAADVWAVVTDTVASGLDKDYLKPDD

SEQ ID NO: 1633 - protein, 28 aa, Artificial Sequence
  Description of Artificial Sequence: Synthetic peptide
  C-term amidated
LSTAADMQGVVWDTVASGLDKDYLKPDD

SEQ ID NO: 1634 - protein, 28 aa, Artificial Sequence
  Description of Artificial Sequence: Synthetic peptide
  N-term acetylated
  C-term amidated
LSTAADMQGVVWDTVASGLDKDYLKPDD

SEQ ID NO: 1635 - protein, 28 aa, Artificial Sequence
  Description of Artificial Sequence: Synthetic peptide
  C-term amidated
LSWAADMQGVVWDTVASGLDKDYLKPDD

SEQ ID NO: 1636 - protein, 28 aa, Artificial Sequence
  Description of Artificial Sequence: Synthetic peptide
  N-term acetylated
  C-term amidated
LSWAADMQGVVWDTVASGLDKDYLKPDD

SEQ ID NO: 1637 - protein, 28 aa, Artificial Sequence
  Description of Artificial Sequence: Synthetic peptide
  C-term amidated
LSTAADLQGVVWDTVASGLDKDYLKPDD

SEQ ID NO: 1638 - protein, 28 aa, Artificial Sequence
  Description of Artificial Sequence: Synthetic peptide
  N-term acetylated
  C-term amidated
LSTAADLQGVVWDTVASGLDKDYLKPDD

SEQ ID NO: 1639 - protein, 28 aa, Artificial Sequence
  Description of Artificial Sequence: Synthetic peptide
  C-term amidated
LSWAADLQGVVWDTVASGLDKDYLKPDD

SEQ ID NO: 1640 - protein, 28 aa, Artificial Sequence
  Description of Artificial Sequence: Synthetic peptide
  N-term acetylated
  C-term amidated
LSWAADLQGVVWDTVASGLDKDYLKPDD

SEQ ID NO: 1641 - protein, 28 aa, Artificial Sequence
  Description of Artificial Sequence: Synthetic peptide
  C-term amidated
LSTAADVQGVVWDTVASGLDKDYLKPDD

SEQ ID NO: 1642 - protein, 28 aa, Artificial Sequence
  Description of Artificial Sequence: Synthetic peptide
  N-term acetylated
  C-term amidated
LSTAADVQGVVWDTVASGLDKDYLKPDD

SEQ ID NO: 1643 - protein, 28 aa, Artificial Sequence
  Description of Artificial Sequence: Synthetic peptide
  C-term amidated
LSWAADVQGVVWDTVASGLDKDYLKPDD

SEQ ID NO: 1644 - protein, 28 aa, Artificial Sequence
  Description of Artificial Sequence: Synthetic peptide
  N-term acetylated
  C-term amidated
LSWAADVQGVVWDTVASGLDKDYLKPDD

SEQ ID NO: 1645 - protein, 28 aa, Artificial Sequence
  Description of Artificial Sequence: Synthetic peptide
  C-term amidated
LSTAADMWGVVWDTVASGLDKDYLKPDD

SEQ ID NO: 1646 - protein, 28 aa, Artificial Sequence
  Description of Artificial Sequence: Synthetic peptide
  N-term acetylated
  C-term amidated
LSTAADMWGVVWDTVASGLDKDYLKPDD

SEQ ID NO: 1647 - protein, 28 aa, Artificial Sequence
  Description of Artificial Sequence: Synthetic peptide
  C-term amidated
LSWAADMWGVVWDTVASGLDKDYLKPDD

SEQ ID NO: 1648 - protein, 28 aa, Artificial Sequence
  Description of Artificial Sequence: Synthetic peptide
  N-term acetylated
  C-term amidated
LSWAADMWGVVWDTVASGLDKDYLKPDD

SEQ ID NO: 1649 - protein, 28 aa, Artificial Sequence
  Description of Artificial Sequence: Synthetic peptide
  C-term amidated
LSTAADLWGVVWDTVASGLDKDYLKPDD

SEQ ID NO: 1650 - protein, 28 aa, Artificial Sequence
  Description of Artificial Sequence: Synthetic peptide
  N-term acetylated
  C-term amidated
LSTAADLWGVVWDTVASGLDKDYLKPDD

SEQ ID NO: 1651 - protein, 28 aa, Artificial Sequence
  Description of Artificial Sequence: Synthetic peptide
  C-term amidated
LSWAADLWGVVWDTVASGLDKDYLKPDD

SEQ ID NO: 1652 - protein, 28 aa, Artificial Sequence
  Description of Artificial Sequence: Synthetic peptide
  N-term acetylated
  C-term amidated
LSWAADLWGVVWDTVASGLDKDYLKPDD

SEQ ID NO: 1653 - protein, 28 aa, Artificial Sequence
  Description of Artificial Sequence: Synthetic peptide
  C-term amidated
LSTAADVWGVVWDTVASGLDKDYLKPDD

SEQ ID NO: 1654 - protein, 28 aa, Artificial Sequence
  Description of Artificial Sequence: Synthetic peptide
  N-term acetylated
  C-term amidated
LSTAADVWGVVWDTVASGLDKDYLKPDD

SEQ ID NO: 1655 - protein, 28 aa, Artificial Sequence
  Description of Artificial Sequence: Synthetic peptide
  C-term amidated
LSWAADVWGVVWDTVASGLDKDYLKPDD

SEQ ID NO: 1656 - protein, 28 aa, Artificial Sequence
  Description of Artificial Sequence: Synthetic peptide
  N-term acetylated
  C-term amidated
LSWAADVWGVVWDTVASGLDKDYLKPDD

SEQ ID NO: 1657 - protein, 28 aa, Artificial Sequence
  Description of Artificial Sequence: Synthetic peptide
  C-term amidated
LSTAADMQAVVWDTVASGLDKDYLKPDD

SEQ ID NO: 1658 - protein, 28 aa, Artificial Sequence
  Description of Artificial Sequence: Synthetic peptide
  N-term acetylated
  C-term amidated
LSTAADMQAVVWDTVASGLDKDYLKPDD

SEQ ID NO: 1659 - protein, 28 aa, Artificial Sequence
  Description of Artificial Sequence: Synthetic peptide
  C-term amidated
LSWAADMQAVVWDTVASGLDKDYLKPDD

SEQ ID NO: 1660 - protein, 28 aa, Artificial Sequence
  Description of Artificial Sequence: Synthetic peptide
  N-term acetylated
  C-term amidated
LSWAADMQAVVWDTVASGLDKDYLKPDD

SEQ ID NO: 1661 - protein, 28 aa, Artificial Sequence
  Description of Artificial Sequence: Synthetic peptide
  C-term amidated
LSTAADLQAVVWDTVASGLDKDYLKPDD

SEQ ID NO: 1662 - protein, 28 aa, Artificial Sequence
  Description of Artificial Sequence: Synthetic peptide
  N-term acetylated
  C-term amidated
LSTAADLQAVVWDTVASGLDKDYLKPDD

SEQ ID NO: 1663 - protein, 28 aa, Artificial Sequence
  Description of Artificial Sequence: Synthetic peptide
  C-term amidated
LSWAADLQAVVWDTVASGLDKDYLKPDD

SEQ ID NO: 1664 - protein, 28 aa, Artificial Sequence
  Description of Artificial Sequence: Synthetic peptide
  N-term acetylated
  C-term amidated
LSWAADLQAVVWDTVASGLDKDYLKPDD

SEQ ID NO: 1665 - protein, 28 aa, Artificial Sequence
  Description of Artificial Sequence: Synthetic peptide
  C-term amidated
LSTAADVQAVVWDTVASGLDKDYLKPDD

SEQ ID NO: 1666 - protein, 28 aa, Artificial Sequence
  Description of Artificial Sequence: Synthetic peptide
  N-term acetylated
  C-term amidated
LSTAADVQAVVWDTVASGLDKDYLKPDD

SEQ ID NO: 1667 - protein, 28 aa, Artificial Sequence
  Description of Artificial Sequence: Synthetic peptide
  C-term amidated
LSWAADVQAVVWDTVASGLDKDYLKPDD

SEQ ID NO: 1668 - protein, 28 aa, Artificial Sequence
  Description of Artificial Sequence: Synthetic peptide
  N-term acetylated
  C-term amidated
LSWAADVQAVVWDTVASGLDKDYLKPDD

SEQ ID NO: 1669 - protein, 28 aa, Artificial Sequence
  Description of Artificial Sequence: Synthetic peptide
  C-term amidated
LSTAADMWAVVWDTVASGLDKDYLKPDD

SEQ ID NO: 1670 - protein, 28 aa, Artificial Sequence
  Description of Artificial Sequence: Synthetic peptide
  N-term acetylated
  C-term amidated
LSTAADMWAVVWDTVASGLDKDYLKPDD

SEQ ID NO: 1671 - protein, 28 aa, Artificial Sequence
  Description of Artificial Sequence: Synthetic peptide
  C-term amidated
LSWAADMWAVVWDTVASGLDKDYLKPDD

SEQ ID NO: 1672 - protein, 28 aa, Artificial Sequence
  Description of Artificial Sequence: Synthetic peptide
  N-term acetylated
  C-term amidated
LSWAADMWAVVWDTVASGLDKDYLKPDD

SEQ ID NO: 1673 - protein, 28 aa, Artificial Sequence
  Description of Artificial Sequence: Synthetic peptide
  C-term amidated
LSTAADLWAVVWDTVASGLDKDYLKPDD

SEQ ID NO: 1674 - protein, 28 aa, Artificial Sequence
  Description of Artificial Sequence: Synthetic peptide
  N-term acetylated
  C-term amidated
LSTAADLWAVVWDTVASGLDKDYLKPDD

SEQ ID NO: 1675 - protein, 28 aa, Artificial Sequence
  Description of Artificial Sequence: Synthetic peptide
  C-term amidated
LSWAADLWAVVWDTVASGLDKDYLKPDD

SEQ ID NO: 1676 - protein, 28 aa, Artificial Sequence
  Description of Artificial Sequence: Synthetic peptide
  N-term acetylated
  C-term amidated
LSWAADLWAVVWDTVASGLDKDYLKPDD

SEQ ID NO: 1677 - protein, 28 aa, Artificial Sequence
  Description of Artificial Sequence: Synthetic peptide
  C-term amidated
LSTAADVWAVVWDTVASGLDKDYLKPDD

SEQ ID NO: 1678 - protein, 28 aa, Artificial Sequence
  Description of Artificial Sequence: Synthetic peptide
  N-term acetylated
  C-term amidated
LSTAADVWAVVWDTVASGLDKDYLKPDD

SEQ ID NO: 1679 - protein, 28 aa, Artificial Sequence
  Description of Artificial Sequence: Synthetic peptide
  C-term amidated
LSWAADVWAVVWDTVASGLDKDYLKPDD

SEQ ID NO: 1680 - protein, 28 aa, Artificial Sequence
  Description of Artificial Sequence: Synthetic peptide
  N-term acetylated
  C-term amidated
LSWAADVWAVVWDTVASGLDKDYLKPDD

SEQ ID NO: 1681 - protein, 28 aa, Artificial Sequence
  Description of Artificial Sequence: Synthetic peptide
  C-term amidated
LSTAADMQGVVTDWVASGLDKDYLKPDD

SEQ ID NO: 1682 - protein, 28 aa, Artificial Sequence
  Description of Artificial Sequence: Synthetic peptide
  N-term acetylated
  C-term amidated
LSTAADMQGVVTDWVASGLDKDYLKPDD

SEQ ID NO: 1683 - protein, 28 aa, Artificial Sequence
  Description of Artificial Sequence: Synthetic peptide
  C-term amidated
LSWAADMQGVVTDWVASGLDKDYLKPDD

SEQ ID NO: 1684 - protein, 28 aa, Artificial Sequence
  Description of Artificial Sequence: Synthetic peptide
  N-term acetylated
  C-term amidated
LSWAADMQGVVTDWVASGLDKDYLKPDD

SEQ ID NO: 1685 - protein, 28 aa, Artificial Sequence
  Description of Artificial Sequence: Synthetic peptide
  C-term amidated
LSTAADLQGVVTDWVASGLDKDYLKPDD

SEQ ID NO: 1686 - protein, 28 aa, Artificial Sequence
  Description of Artificial Sequence: Synthetic peptide
  N-term acetylated
  C-term amidated
LSTAADLQGVVTDWVASGLDKDYLKPDD

SEQ ID NO: 1687 - protein, 28 aa, Artificial Sequence
  Description of Artificial Sequence: Synthetic peptide
  C-term amidated
LSWAADLQGVVTDWVASGLDKDYLKPDD

SEQ ID NO: 1688 - protein, 28 aa, Artificial Sequence
  Description of Artificial Sequence: Synthetic peptide
  N-term acetylated
  C-term amidated
LSWAADLQGVVTDWVASGLDKDYLKPDD

SEQ ID NO: 1689 - protein, 28 aa, Artificial Sequence
  Description of Artificial Sequence: Synthetic peptide
  C-term amidated
LSTAADVQGVVTDWVASGLDKDYLKPDD

SEQ ID NO: 1690 - protein, 28 aa, Artificial Sequence
  Description of Artificial Sequence: Synthetic peptide
  N-term acetylated
  C-term amidated
LSTAADVQGVVTDWVASGLDKDYLKPDD

SEQ ID NO: 1691 - protein, 28 aa, Artificial Sequence
  Description of Artificial Sequence: Synthetic peptide
  C-term amidated
LSWAADVQGVVTDWVASGLDKDYLKPDD

SEQ ID NO: 1692 - protein, 28 aa, Artificial Sequence
  Description of Artificial Sequence: Synthetic peptide
  N-term acetylated
  C-term amidated
LSWAADVQGVVTDWVASGLDKDYLKPDD

SEQ ID NO: 1693 - protein, 28 aa, Artificial Sequence
  Description of Artificial Sequence: Synthetic peptide
  C-term amidated
LSTAADMWGVVTDWVASGLDKDYLKPDD

SEQ ID NO: 1694 - protein, 28 aa, Artificial Sequence
  Description of Artificial Sequence: Synthetic peptide
  N-term acetylated
  C-term amidated
LSTAADMWGVVTDWVASGLDKDYLKPDD

SEQ ID NO: 1695 - protein, 28 aa, Artificial Sequence
  Description of Artificial Sequence: Synthetic peptide
  C-term amidated
LSWAADMWGVVTDWVASGLDKDYLKPDD

SEQ ID NO: 1696 - protein, 28 aa, Artificial Sequence
  Description of Artificial Sequence: Synthetic peptide
  N-term acetylated
  C-term amidated
LSWAADMWGVVTDWVASGLDKDYLKPDD

SEQ ID NO: 1697 - protein, 28 aa, Artificial Sequence
  Description of Artificial Sequence: Synthetic peptide
  C-term amidated
LSTAADLWGVVTDWVASGLDKDYLKPDD

SEQ ID NO: 1698 - protein, 28 aa, Artificial Sequence
  Description of Artificial Sequence: Synthetic peptide
  N-term acetylated
  C-term amidated
LSTAADLWGVVTDWVASGLDKDYLKPDD

SEQ ID NO: 1699 - protein, 28 aa, Artificial Sequence
  Description of Artificial Sequence: Synthetic peptide
  C-term amidated
LSWAADLWGVVTDWVASGLDKDYLKPDD

SEQ ID NO: 1700 - protein, 28 aa, Artificial Sequence
  Description of Artificial Sequence: Synthetic peptide
  N-term acetylated
  C-term amidated
LSWAADLWGVVTDWVASGLDKDYLKPDD

SEQ ID NO: 1701 - protein, 28 aa, Artificial Sequence
  Description of Artificial Sequence: Synthetic peptide
  C-term amidated
LSTAADVWGVVTDWVASGLDKDYLKPDD

SEQ ID NO: 1702 - protein, 28 aa, Artificial Sequence
  Description of Artificial Sequence: Synthetic peptide
  N-term acetylated
  C-term amidated
LSTAADVWGVVTDWVASGLDKDYLKPDD

SEQ ID NO: 1703 - protein, 28 aa, Artificial Sequence
  Description of Artificial Sequence: Synthetic peptide
  C-term amidated
LSWAADVWGVVTDWVASGLDKDYLKPDD

SEQ ID NO: 1704 - protein, 28 aa, Artificial Sequence
  Description of Artificial Sequence: Synthetic peptide
  N-term acetylated
  C-term amidated
LSWAADVWGVVTDWVASGLDKDYLKPDD

SEQ ID NO: 1705 - protein, 28 aa, Artificial Sequence
  Description of Artificial Sequence: Synthetic peptide
  C-term amidated
LSTAADMQAVVTDWVASGLDKDYLKPDD

SEQ ID NO: 1706 - protein, 28 aa, Artificial Sequence
  Description of Artificial Sequence: Synthetic peptide
  N-term acetylated
  C-term amidated
LSTAADMQAVVTDWVASGLDKDYLKPDD

SEQ ID NO: 1707 - protein, 28 aa, Artificial Sequence
  Description of Artificial Sequence: Synthetic peptide
  C-term amidated
LSWAADMQAVVTDWVASGLDKDYLKPDD

SEQ ID NO: 1708 - protein, 28 aa, Artificial Sequence
  Description of Artificial Sequence: Synthetic peptide
  N-term acetylated
  C-term amidated
LSWAADMQAVVTDWVASGLDKDYLKPDD

SEQ ID NO: 1709 - protein, 28 aa, Artificial Sequence
  Description of Artificial Sequence: Synthetic peptide
  C-term amidated
LSTAADLQAVVTDWVASGLDKDYLKPDD

SEQ ID NO: 1710 - protein, 28 aa, Artificial Sequence
  Description of Artificial Sequence: Synthetic peptide
  N-term acetylated
  C-term amidated
LSTAADLQAVVTDWVASGLDKDYLKPDD

SEQ ID NO: 1711 - protein, 28 aa, Artificial Sequence
  Description of Artificial Sequence: Synthetic peptide
  C-term amidated
LSWAADLQAVVTDWVASGLDKDYLKPDD

SEQ ID NO: 1712 - protein, 28 aa, Artificial Sequence
  Description of Artificial Sequence: Synthetic peptide
  N-term acetylated
  C-term amidated
LSWAADLQAVVTDWVASGLDKDYLKPDD

SEQ ID NO: 1713 - protein, 28 aa, Artificial Sequence
  Description of Artificial Sequence: Synthetic peptide
  C-term amidated
LSTAADVQAVVTDWVASGLDKDYLKPDD

SEQ ID NO: 1714 - protein, 28 aa, Artificial Sequence
  Description of Artificial Sequence: Synthetic peptide
  N-term acetylated
  C-term amidated
LSTAADVQAVVTDWVASGLDKDYLKPDD

SEQ ID NO: 1715 - protein, 28 aa, Artificial Sequence
  Description of Artificial Sequence: Synthetic peptide
  C-term amidated
LSWAADVQAVVTDWVASGLDKDYLKPDD

SEQ ID NO: 1716 - protein, 28 aa, Artificial Sequence
  Description of Artificial Sequence: Synthetic peptide
  N-term acetylated
  C-term amidated
LSWAADVQAVVTDWVASGLDKDYLKPDD

SEQ ID NO: 1717 - protein, 28 aa, Artificial Sequence
  Description of Artificial Sequence: Synthetic peptide
  C-term amidated
LSTAADMWAVVTDWVASGLDKDYLKPDD

SEQ ID NO: 1718 - protein, 28 aa, Artificial Sequence
  Description of Artificial Sequence: Synthetic peptide
  N-term acetylated
  C-term amidated
LSTAADMWAVVTDWVASGLDKDYLKPDD

SEQ ID NO: 1719 - protein, 28 aa, Artificial Sequence
  Description of Artificial Sequence: Synthetic peptide
  C-term amidated
LSWAADMWAVVTDWVASGLDKDYLKPDD

SEQ ID NO: 1720 - protein, 28 aa, Artificial Sequence
  Description of Artificial Sequence: Synthetic peptide
  N-term acetylated
  C-term amidated
LSWAADMWAVVTDWVASGLDKDYLKPDD

SEQ ID NO: 1721 - protein, 28 aa, Artificial Sequence
  Description of Artificial Sequence: Synthetic peptide
  C-term amidated
LSTAADLWAVVTDWVASGLDKDYLKPDD

SEQ ID NO: 1722 - protein, 28 aa, Artificial Sequence
  Description of Artificial Sequence: Synthetic peptide
  N-term acetylated
  C-term amidated
LSTAADLWAVVTDWVASGLDKDYLKPDD

SEQ ID NO: 1723 - protein, 28 aa, Artificial Sequence
  Description of Artificial Sequence: Synthetic peptide
  C-term amidated
LSWAADLWAVVTDWVASGLDKDYLKPDD

SEQ ID NO: 1724 - protein, 28 aa, Artificial Sequence
  Description of Artificial Sequence: Synthetic peptide
  N-term acetylated
  C-term amidated
LSWAADLWAVVTDWVASGLDKDYLKPDD

SEQ ID NO: 1725 - protein, 28 aa, Artificial Sequence
  Description of Artificial Sequence: Synthetic peptide
  C-term amidated
LSTAADVWAVVTDWVASGLDKDYLKPDD

SEQ ID NO: 1726 - protein, 28 aa, Artificial Sequence
  Description of Artificial Sequence: Synthetic peptide
  N-term acetylated
  C-term amidated
LSTAADVWAVVTDWVASGLDKDYLKPDD

SEQ ID NO: 1727 - protein, 28 aa, Artificial Sequence
  Description of Artificial Sequence: Synthetic peptide
  C-term amidated
LSWAADVWAVVTDWVASGLDKDYLKPDD

SEQ ID NO: 1728 - protein, 28 aa, Artificial Sequence
  Description of Artificial Sequence: Synthetic peptide
  N-term acetylated
  C-term amidated
LSWAADVWAVVTDWVASGLDKDYLKPDD

SEQ ID NO: 1729 - protein, 28 aa, Artificial Sequence
  Description of Artificial Sequence: Synthetic peptide
  C-term amidated
LSTAADMQGVVWDWVASGLDKDYLKPDD

SEQ ID NO: 1730 - protein, 28 aa, Artificial Sequence
  Description of Artificial Sequence: Synthetic peptide
  N-term acetylated
  C-term amidated
LSTAADMQGVVWDWVASGLDKDYLKPDD

SEQ ID NO: 1731 - protein, 28 aa, Artificial Sequence
  Description of Artificial Sequence: Synthetic peptide
  C-term amidated
LSWAADMQGVVWDWVASGLDKDYLKPDD

SEQ ID NO: 1732 - protein, 28 aa, Artificial Sequence
  Description of Artificial Sequence: Synthetic peptide
  N-term acetylated
  C-term amidated
LSWAADMQGVVWDWVASGLDKDYLKPDD

SEQ ID NO: 1733 - protein, 28 aa, Artificial Sequence
  Description of Artificial Sequence: Synthetic peptide
  C-term amidated
LSTAADLQGVVWDWVASGLDKDYLKPDD

SEQ ID NO: 1734 - protein, 28 aa, Artificial Sequence
  Description of Artificial Sequence: Synthetic peptide
  N-term acetylated
  C-term amidated
LSTAADLQGVVWDWVASGLDKDYLKPDD

SEQ ID NO: 1735 - protein, 28 aa, Artificial Sequence
  Description of Artificial Sequence: Synthetic peptide
  C-term amidated
LSWAADLQGVVWDWVASGLDKDYLKPDD

SEQ ID NO: 1736 - protein, 28 aa, Artificial Sequence
  Description of Artificial Sequence: Synthetic peptide
  N-term acetylated
  C-term amidated
LSWAADLQGVVWDWVASGLDKDYLKPDD

SEQ ID NO: 1737 - protein, 28 aa, Artificial Sequence
  Description of Artificial Sequence: Synthetic peptide
  C-term amidated
LSTAADVQGVVWDWVASGLDKDYLKPDD

SEQ ID NO: 1738 - protein, 28 aa, Artificial Sequence
  Description of Artificial Sequence: Synthetic peptide
  N-term acetylated
  C-term amidated
LSTAADVQGVVWDWVASGLDKDYLKPDD

SEQ ID NO: 1739 - protein, 28 aa, Artificial Sequence
  Description of Artificial Sequence: Synthetic peptide
  C-term amidated
LSWAADVQGVVWDWVASGLDKDYLKPDD

SEQ ID NO: 1740 - protein, 28 aa, Artificial Sequence
  Description of Artificial Sequence: Synthetic peptide
  N-term acetylated
  C-term amidated
LSWAADVQGVVWDWVASGLDKDYLKPDD

SEQ ID NO: 1741 - protein, 28 aa, Artificial Sequence
  Description of Artificial Sequence: Synthetic peptide
  C-term amidated
LSTAADMWGVVWDWVASGLDKDYLKPDD

SEQ ID NO: 1742 - protein, 28 aa, Artificial Sequence
  Description of Artificial Sequence: Synthetic peptide
  N-term acetylated
  C-term amidated
LSTAADMWGVVWDWVASGLDKDYLKPDD

SEQ ID NO: 1743 - protein, 28 aa, Artificial Sequence
  Description of Artificial Sequence: Synthetic peptide
  C-term amidated
LSWAADMWGVVWDWVASGLDKDYLKPDD

SEQ ID NO: 1744 - protein, 28 aa, Artificial Sequence
  Description of Artificial Sequence: Synthetic peptide
  N-term acetylated
  C-term amidated
LSWAADMWGVVWDWVASGLDKDYLKPDD

SEQ ID NO: 1745 - protein, 28 aa, Artificial Sequence
  Description of Artificial Sequence: Synthetic peptide
  C-term amidated
LSTAADLWGVVWDWVASGLDKDYLKPDD

SEQ ID NO: 1746 - protein, 28 aa, Artificial Sequence
  Description of Artificial Sequence: Synthetic peptide
  N-term acetylated
  C-term amidated
LSTAADLWGVVWDWVASGLDKDYLKPDD

SEQ ID NO: 1747 - protein, 28 aa, Artificial Sequence
  Description of Artificial Sequence: Synthetic peptide
  C-term amidated
LSWAADLWGVVWDWVASGLDKDYLKPDD

SEQ ID NO: 1748 - protein, 28 aa, Artificial Sequence
  Description of Artificial Sequence: Synthetic peptide
  N-term acetylated
  C-term amidated
LSWAADLWGVVWDWVASGLDKDYLKPDD

SEQ ID NO: 1749 - protein, 28 aa, Artificial Sequence
  Description of Artificial Sequence: Synthetic peptide
  C-term amidated
LSTAADVWGVVWDWVASGLDKDYLKPDD

SEQ ID NO: 1750 - protein, 28 aa, Artificial Sequence
  Description of Artificial Sequence: Synthetic peptide
  N-term acetylated
  C-term amidated
LSTAADVWGVVWDWVASGLDKDYLKPDD

SEQ ID NO: 1751 - protein, 28 aa, Artificial Sequence
  Description of Artificial Sequence: Synthetic peptide
  C-term amidated
LSWAADVWGVVWDWVASGLDKDYLKPDD

SEQ ID NO: 1752 - protein, 28 aa, Artificial Sequence
  Description of Artificial Sequence: Synthetic peptide
  N-term acetylated
  C-term amidated
LSWAADVWGVVWDWVASGLDKDYLKPDD

SEQ ID NO: 1753 - protein, 28 aa, Artificial Sequence
  Description of Artificial Sequence: Synthetic peptide
  C-term amidated
LSTAADMQAVVWDWVASGLDKDYLKPDD

SEQ ID NO: 1754 - protein, 28 aa, Artificial Sequence
  Description of Artificial Sequence: Synthetic peptide
  N-term acetylated
  C-term amidated
LSTAADMQAVVWDWVASGLDKDYLKPDD

SEQ ID NO: 1755 - protein, 28 aa, Artificial Sequence
  Description of Artificial Sequence: Synthetic peptide
  C-term amidated
LSWAADMQAVVWDWVASGLDKDYLKPDD

SEQ ID NO: 1756 - protein, 28 aa, Artificial Sequence
  Description of Artificial Sequence: Synthetic peptide
  N-term acetylated
  C-term amidated
LSWAADMQAVVWDWVASGLDKDYLKPDD

SEQ ID NO: 1757 - protein, 28 aa, Artificial Sequence
  Description of Artificial Sequence: Synthetic peptide
  C-term amidated
LSTAADLQAVVWDWVASGLDKDYLKPDD

SEQ ID NO: 1758 - protein, 28 aa, Artificial Sequence
  Description of Artificial Sequence: Synthetic peptide
  N-term acetylated
  C-term amidated
LSTAADLQAVVWDWVASGLDKDYLKPDD

SEQ ID NO: 1759 - protein, 28 aa, Artificial Sequence
  Description of Artificial Sequence: Synthetic peptide
  C-term amidated
LSWAADLQAVVWDWVASGLDKDYLKPDD

SEQ ID NO: 1760 - protein, 28 aa, Artificial Sequence
  Description of Artificial Sequence: Synthetic peptide
  N-term acetylated
  C-term amidated
LSWAADLQAVVWDWVASGLDKDYLKPDD

SEQ ID NO: 1761 - protein, 28 aa, Artificial Sequence
  Description of Artificial Sequence: Synthetic peptide
  C-term amidated
LSTAADVQAVVWDWVASGLDKDYLKPDD

SEQ ID NO: 1762 - protein, 28 aa, Artificial Sequence
  Description of Artificial Sequence: Synthetic peptide
  N-term acetylated
  C-term amidated
LSTAADVQAVVWDWVASGLDKDYLKPDD

SEQ ID NO: 1763 - protein, 28 aa, Artificial Sequence
  Description of Artificial Sequence: Synthetic peptide
  C-term amidated
LSWAADVQAVVWDWVASGLDKDYLKPDD

SEQ ID NO: 1764 - protein, 28 aa, Artificial Sequence
  Description of Artificial Sequence: Synthetic peptide
  N-term acetylated
  C-term amidated
LSWAADVQAVVWDWVASGLDKDYLKPDD

SEQ ID NO: 1765 - protein, 28 aa, Artificial Sequence
  Description of Artificial Sequence: Synthetic peptide
  C-term amidated
LSTAADMWAVVWDWVASGLDKDYLKPDD

SEQ ID NO: 1766 - protein, 28 aa, Artificial Sequence
  Description of Artificial Sequence: Synthetic peptide
  N-term acetylated
  C-term amidated
LSTAADMWAVVWDWVASGLDKDYLKPDD

SEQ ID NO: 1767 - protein, 28 aa, Artificial Sequence
  Description of Artificial Sequence: Synthetic peptide
  C-term amidated
LSWAADMWAVVWDWVASGLDKDYLKPDD

SEQ ID NO: 1768 - protein, 28 aa, Artificial Sequence
  Description of Artificial Sequence: Synthetic peptide
  N-term acetylated
  C-term amidated
LSWAADMWAVVWDWVASGLDKDYLKPDD

SEQ ID NO: 1769 - protein, 28 aa, Artificial Sequence
  Description of Artificial Sequence: Synthetic peptide
  C-term amidated
LSTAADLWAVVWDWVASGLDKDYLKPDD

SEQ ID NO: 1770 - protein, 28 aa, Artificial Sequence
  Description of Artificial Sequence: Synthetic peptide
  N-term acetylated
  C-term amidated
LSTAADLWAVVWDWVASGLDKDYLKPDD

SEQ ID NO: 1771 - protein, 28 aa, Artificial Sequence
  Description of Artificial Sequence: Synthetic peptide
  C-term amidated
LSWAADLWAVVWDWVASGLDKDYLKPDD

SEQ ID NO: 1772 - protein, 28 aa, Artificial Sequence
  Description of Artificial Sequence: Synthetic peptide
  N-term acetylated
  C-term amidated
LSWAADLWAVVWDWVASGLDKDYLKPDD

SEQ ID NO: 1773 - protein, 28 aa, Artificial Sequence
  Description of Artificial Sequence: Synthetic peptide
  C-term amidated
LSTAADVWAVVWDWVASGLDKDYLKPDD

SEQ ID NO: 1774 - protein, 28 aa, Artificial Sequence
  Description of Artificial Sequence: Synthetic peptide
  N-term acetylated
  C-term amidated
LSTAADVWAVVWDWVASGLDKDYLKPDD

SEQ ID NO: 1775 - protein, 28 aa, Artificial Sequence
  Description of Artificial Sequence: Synthetic peptide
  C-term amidated
LSWAADVWAVVWDWVASGLDKDYLKPDD

SEQ ID NO: 1776 - protein, 28 aa, Artificial Sequence
  Description of Artificial Sequence: Synthetic peptide
  N-term acetylated
  C-term amidated
LSWAADVWAVVWDWVASGLDKDYLKPDD

SEQ ID NO: 1777 - protein, 28 aa, Artificial Sequence
  Description of Artificial Sequence: Synthetic peptide
  N-term acetylated
  C-term amidated
DDPKLYDKDLGSAVWDWVVAWVDAAWSL

SEQ ID NO: 1778 - protein, 28 aa, Artificial Sequence
  Description of Artificial Sequence: Synthetic peptide
  N-term acetylated
DDPKLYDKDLGSAVWDWVVAWVDAAWSL

SEQ ID NO: 1779 - protein, 28 aa, Artificial Sequence
  Description of Artificial Sequence: Synthetic peptide
  N-term acetylated
  C-term amidated
DDPKLYDKDLGSAVWDWVVAWVDAATSL

SEQ ID NO: 1780 - protein, 28 aa, Artificial Sequence
  Description of Artificial Sequence: Synthetic peptide
  N-term acetylated
DDPKLYDKDLGSAVWDWVVAWVDAATSL

SEQ ID NO: 1781 - protein, 28 aa, Artificial Sequence
  Description of Artificial Sequence: Synthetic peptide
  N-term acetylated
  C-term amidated
DDPKLYDKDLGSAVWDWVVAWLDAAWSL

SEQ ID NO: 1782 - protein, 28 aa, Artificial Sequence
  Description of Artificial Sequence: Synthetic peptide
  N-term acetylated
DDPKLYDKDLGSAVWDWVVAWLDAAWSL

SEQ ID NO: 1783 - protein, 28 aa, Artificial Sequence
  Description of Artificial Sequence: Synthetic peptide
  N-term acetylated
  C-term amidated
DDPKLYDKDLGSAVWDWVVAWLDAATSL

SEQ ID NO: 1784 - protein, 28 aa, Artificial Sequence
  Description of Artificial Sequence: Synthetic peptide
  N-term acetylated
DDPKLYDKDLGSAVWDWVVAWLDAATSL

SEQ ID NO: 1785 - protein, 28 aa, Artificial Sequence
  Description of Artificial Sequence: Synthetic peptide
  N-term acetylated
  C-term amidated
DDPKLYDKDLGSAVWDWVVAWMDAAWSL

SEQ ID NO: 1786 - protein, 28 aa, Artificial Sequence
  Description of Artificial Sequence: Synthetic peptide
  N-term acetylated
DDPKLYDKDLGSAVWDWVVAWMDAAWSL

SEQ ID NO: 1787 - protein, 28 aa, Artificial Sequence
  Description of Artificial Sequence: Synthetic peptide
  N-term acetylated
  C-term amidated
DDPKLYDKDLGSAVWDWVVAWMDAATSL

SEQ ID NO: 1788 - protein, 28 aa, Artificial Sequence
  Description of Artificial Sequence: Synthetic peptide
  N-term acetylated
DDPKLYDKDLGSAVWDWVVAWMDAATSL

SEQ ID NO: 1789 - protein, 28 aa, Artificial Sequence
  Description of Artificial Sequence: Synthetic peptide
  N-term acetylated
  C-term amidated
DDPKLYDKDLGSAVWDWVVAQVDAAWSL

SEQ ID NO: 1790 - protein, 28 aa, Artificial Sequence
  Description of Artificial Sequence: Synthetic peptide
  N-term acetylated
DDPKLYDKDLGSAVWDWVVAQVDAAWSL

SEQ ID NO: 1791 - protein, 28 aa, Artificial Sequence
  Description of Artificial Sequence: Synthetic peptide
  N-term acetylated
  C-term amidated
DDPKLYDKDLGSAVWDWVVAQVDAATSL

SEQ ID NO: 1792 - protein, 28 aa, Artificial Sequence
  Description of Artificial Sequence: Synthetic peptide
  N-term acetylated
DDPKLYDKDLGSAVWDWVVAQVDAATSL

SEQ ID NO: 1793 - protein, 28 aa, Artificial Sequence
  Description of Artificial Sequence: Synthetic peptide
  N-term acetylated
  C-term amidated
DDPKLYDKDLGSAVWDWVVAQLDAAWSL

SEQ ID NO: 1794 - protein, 28 aa, Artificial Sequence
  Description of Artificial Sequence: Synthetic peptide
  N-term acetylated
DDPKLYDKDLGSAVWDWVVAQLDAAWSL

SEQ ID NO: 1795 - protein, 28 aa, Artificial Sequence
  Description of Artificial Sequence: Synthetic peptide
  N-term acetylated
  C-term amidated
DDPKLYDKDLGSAVWDWVVAQLDAATSL

SEQ ID NO: 1796 - protein, 28 aa, Artificial Sequence
  Description of Artificial Sequence: Synthetic peptide
  N-term acetylated
DDPKLYDKDLGSAVWDWVVAQLDAATSL

SEQ ID NO: 1797 - protein, 28 aa, Artificial Sequence
  Description of Artificial Sequence: Synthetic peptide
  N-term acetylated
  C-term amidated
DDPKLYDKDLGSAVWDWVVAQMDAAWSL

SEQ ID NO: 1798 - protein, 28 aa, Artificial Sequence
  Description of Artificial Sequence: Synthetic peptide
  N-term acetylated
DDPKLYDKDLGSAVWDWVVAQMDAAWSL

SEQ ID NO: 1799 - protein, 28 aa, Artificial Sequence
  Description of Artificial Sequence: Synthetic peptide
  N-term acetylated
  C-term amidated
DDPKLYDKDLGSAVWDWVVAQMDAATSL

SEQ ID NO: 1800 - protein, 28 aa, Artificial Sequence
  Description of Artificial Sequence: Synthetic peptide
  N-term acetylated
DDPKLYDKDLGSAVWDWVVAQMDAATSL

SEQ ID NO: 1801 - protein, 28 aa, Artificial Sequence
  Description of Artificial Sequence: Synthetic peptide
  N-term acetylated
  C-term amidated
DDPKLYDKDLGSAVWDWVVGWVDAAWSL

SEQ ID NO: 1802 - protein, 28 aa, Artificial Sequence
  Description of Artificial Sequence: Synthetic peptide
  N-term acetylated
DDPKLYDKDLGSAVWDWVVGWVDAAWSL

SEQ ID NO: 1803 - protein, 28 aa, Artificial Sequence
  Description of Artificial Sequence: Synthetic peptide
  N-term acetylated
  C-term amidated
DDPKLYDKDLGSAVWDWVVGWVDAATSL

SEQ ID NO: 1804 - protein, 28 aa, Artificial Sequence
  Description of Artificial Sequence: Synthetic peptide
  N-term acetylated
DDPKLYDKDLGSAVWDWVVGWVDAATSL

SEQ ID NO: 1805 - protein, 28 aa, Artificial Sequence
  Description of Artificial Sequence: Synthetic peptide
  N-term acetylated
  C-term amidated
DDPKLYDKDLGSAVWDWVVGWLDAAWSL

SEQ ID NO: 1806 - protein, 28 aa, Artificial Sequence
  Description of Artificial Sequence: Synthetic peptide
  N-term acetylated
DDPKLYDKDLGSAVWDWVVGWLDAAWSL

SEQ ID NO: 1807 - protein, 28 aa, Artificial Sequence
  Description of Artificial Sequence: Synthetic peptide
  N-term acetylated
  C-term amidated
DDPKLYDKDLGSAVWDWVVGWLDAATSL

SEQ ID NO: 1808 - protein, 28 aa, Artificial Sequence
  Description of Artificial Sequence: Synthetic peptide
  N-term acetylated
DDPKLYDKDLGSAVWDWVVGWLDAATSL

SEQ ID NO: 1809 - protein, 28 aa, Artificial Sequence
  Description of Artificial Sequence: Synthetic peptide
  N-term acetylated
  C-term amidated
DDPKLYDKDLGSAVWDWVVGWMDAAWSL

SEQ ID NO: 1810 - protein, 28 aa, Artificial Sequence
  Description of Artificial Sequence: Synthetic peptide
  N-term acetylated
DDPKLYDKDLGSAVWDWVVGWMDAAWSL

SEQ ID NO: 1811 - protein, 28 aa, Artificial Sequence
  Description of Artificial Sequence: Synthetic peptide
  N-term acetylated
  C-term amidated
DDPKLYDKDLGSAVWDWVVGWMDAATSL

SEQ ID NO: 1812 - protein, 28 aa, Artificial Sequence
  Description of Artificial Sequence: Synthetic peptide
  N-term acetylated
DDPKLYDKDLGSAVWDWVVGWMDAATSL

SEQ ID NO: 1813 - protein, 28 aa, Artificial Sequence
  Description of Artificial Sequence: Synthetic peptide
  N-term acetylated
  C-term amidated
DDPKLYDKDLGSAVWDWVVGQVDAAWSL

SEQ ID NO: 1814 - protein, 28 aa, Artificial Sequence
  Description of Artificial Sequence: Synthetic peptide
  N-term acetylated
DDPKLYDKDLGSAVWDWVVGQVDAAWSL

SEQ ID NO: 1815 - protein, 28 aa, Artificial Sequence
  Description of Artificial Sequence: Synthetic peptide
  N-term acetylated
  C-term amidated
DDPKLYDKDLGSAVWDWVVGQVDAATSL

SEQ ID NO: 1816 - protein, 28 aa, Artificial Sequence
  Description of Artificial Sequence: Synthetic peptide
  N-term acetylated
DDPKLYDKDLGSAVWDWVVGQVDAATSL

SEQ ID NO: 1817 - protein, 28 aa, Artificial Sequence
  Description of Artificial Sequence: Synthetic peptide
  N-term acetylated
  C-term amidated
DDPKLYDKDLGSAVWDWVVGQLDAAWSL

SEQ ID NO: 1818 - protein, 28 aa, Artificial Sequence
  Description of Artificial Sequence: Synthetic peptide
  N-term acetylated
DDPKLYDKDLGSAVWDWVVGQLDAAWSL

SEQ ID NO: 1819 - protein, 28 aa, Artificial Sequence
  Description of Artificial Sequence: Synthetic peptide
  N-term acetylated
  C-term amidated
DDPKLYDKDLGSAVWDWVVGQLDAATSL

SEQ ID NO: 1820 - protein, 28 aa, Artificial Sequence
  Description of Artificial Sequence: Synthetic peptide
  N-term acetylated
DDPKLYDKDLGSAVWDWVVGQLDAATSL

SEQ ID NO: 1821 - protein, 28 aa, Artificial Sequence
  Description of Artificial Sequence: Synthetic peptide
  N-term acetylated
  C-term amidated
DDPKLYDKDLGSAVWDWVVGQMDAAWSL

SEQ ID NO: 1822 - protein, 28 aa, Artificial Sequence
  Description of Artificial Sequence: Synthetic peptide
  N-term acetylated
DDPKLYDKDLGSAVWDWVVGQMDAAWSL

SEQ ID NO: 1823 - protein, 28 aa, Artificial Sequence
  Description of Artificial Sequence: Synthetic peptide
  N-term acetylated
  C-term amidated
DDPKLYDKDLGSAVWDWVVGQMDAATSL

SEQ ID NO: 1824 - protein, 28 aa, Artificial Sequence
  Description of Artificial Sequence: Synthetic peptide
  N-term acetylated
DDPKLYDKDLGSAVWDWVVGQMDAATSL

SEQ ID NO: 1825 - protein, 28 aa, Artificial Sequence
  Description of Artificial Sequence: Synthetic peptide
  N-term acetylated
  C-term amidated
DDPKLYDKDLGSAVWDTVVAWVDAAWSL

SEQ ID NO: 1826 - protein, 28 aa, Artificial Sequence
  Description of Artificial Sequence: Synthetic peptide
  N-term acetylated
DDPKLYDKDLGSAVWDTVVAWVDAAWSL

SEQ ID NO: 1827 - protein, 28 aa, Artificial Sequence
  Description of Artificial Sequence: Synthetic peptide
  N-term acetylated
  C-term amidated
DDPKLYDKDLGSAVWDTVVAWVDAATSL

SEQ ID NO: 1828 - protein, 28 aa, Artificial Sequence
  Description of Artificial Sequence: Synthetic peptide
  N-term acetylated
DDPKLYDKDLGSAVWDTVVAWVDAATSL

SEQ ID NO: 1829 - protein, 28 aa, Artificial Sequence
  Description of Artificial Sequence: Synthetic peptide
  N-term acetylated
  C-term amidated
DDPKLYDKDLGSAVWDTVVAWLDAAWSL

SEQ ID NO: 1830 - protein, 28 aa, Artificial Sequence
  Description of Artificial Sequence: Synthetic peptide
  N-term acetylated
DDPKLYDKDLGSAVWDTVVAWLDAAWSL

SEQ ID NO: 1831 - protein, 28 aa, Artificial Sequence
  Description of Artificial Sequence: Synthetic peptide
  N-term acetylated
  C-term amidated
DDPKLYDKDLGSAVWDTVVAWLDAATSL

SEQ ID NO: 1832 - protein, 28 aa, Artificial Sequence
  Description of Artificial Sequence: Synthetic peptide
  N-term acetylated
DDPKLYDKDLGSAVWDTVVAWLDAATSL

SEQ ID NO: 1833 - protein, 28 aa, Artificial Sequence
  Description of Artificial Sequence: Synthetic peptide
  N-term acetylated
  C-term amidated
DDPKLYDKDLGSAVWDTVVAWMDAAWSL

SEQ ID NO: 1834 - protein, 28 aa, Artificial Sequence
  Description of Artificial Sequence: Synthetic peptide
  N-term acetylated
DDPKLYDKDLGSAVWDTVVAWMDAAWSL

SEQ ID NO: 1835 - protein, 28 aa, Artificial Sequence
  Description of Artificial Sequence: Synthetic peptide
  N-term acetylated
  C-term amidated
DDPKLYDKDLGSAVWDTVVAWMDAATSL

SEQ ID NO: 1836 - protein, 28 aa, Artificial Sequence
  Description of Artificial Sequence: Synthetic peptide
  N-term acetylated
DDPKLYDKDLGSAVWDTVVAWMDAATSL

SEQ ID NO: 1837 - protein, 28 aa, Artificial Sequence
  Description of Artificial Sequence: Synthetic peptide
  N-term acetylated
  C-term amidated
DDPKLYDKDLGSAVWDTVVAQVDAAWSL

SEQ ID NO: 1838 - protein, 28 aa, Artificial Sequence
  Description of Artificial Sequence: Synthetic peptide
  N-term acetylated
DDPKLYDKDLGSAVWDTVVAQVDAAWSL

SEQ ID NO: 1839 - protein, 28 aa, Artificial Sequence
  Description of Artificial Sequence: Synthetic peptide
  N-term acetylated
  C-term amidated
DDPKLYDKDLGSAVWDTVVAQVDAATSL

SEQ ID NO: 1840 - protein, 28 aa, Artificial Sequence
  Description of Artificial Sequence: Synthetic peptide
  N-term acetylated
DDPKLYDKDLGSAVWDTVVAQVDAATSL

SEQ ID NO: 1841 - protein, 28 aa, Artificial Sequence
  Description of Artificial Sequence: Synthetic peptide
  N-term acetylated
  C-term amidated
DDPKLYDKDLGSAVWDTVVAQLDAAWSL

SEQ ID NO: 1842 - protein, 28 aa, Artificial Sequence
  Description of Artificial Sequence: Synthetic peptide
  N-term acetylated
DDPKLYDKDLGSAVWDTVVAQLDAAWSL

SEQ ID NO: 1843 - protein, 28 aa, Artificial Sequence
  Description of Artificial Sequence: Synthetic peptide
  N-term acetylated
  C-term amidated
DDPKLYDKDLGSAVWDTVVAQLDAATSL

SEQ ID NO: 1844 - protein, 28 aa, Artificial Sequence
  Description of Artificial Sequence: Synthetic peptide
  N-term acetylated
DDPKLYDKDLGSAVWDTVVAQLDAATSL

SEQ ID NO: 1845 - protein, 28 aa, Artificial Sequence
  Description of Artificial Sequence: Synthetic peptide
  N-term acetylated
  C-term amidated
DDPKLYDKDLGSAVWDTVVAQMDAAWSL

SEQ ID NO: 1846 - protein, 28 aa, Artificial Sequence
  Description of Artificial Sequence: Synthetic peptide
  N-term acetylated
DDPKLYDKDLGSAVWDTVVAQMDAAWSL

SEQ ID NO: 1847 - protein, 28 aa, Artificial Sequence
  Description of Artificial Sequence: Synthetic peptide
  N-term acetylated
  C-term amidated
DDPKLYDKDLGSAVWDTVVAQMDAATSL

SEQ ID NO: 1848 - protein, 28 aa, Artificial Sequence
  Description of Artificial Sequence: Synthetic peptide
  N-term acetylated
DDPKLYDKDLGSAVWDTVVAQMDAATSL

SEQ ID NO: 1849 - protein, 28 aa, Artificial Sequence
  Description of Artificial Sequence: Synthetic peptide
  N-term acetylated
  C-term amidated
DDPKLYDKDLGSAVWDTVVGWVDAAWSL

SEQ ID NO: 1850 - protein, 28 aa, Artificial Sequence
  Description of Artificial Sequence: Synthetic peptide
  N-term acetylated
DDPKLYDKDLGSAVWDTVVGWVDAAWSL

SEQ ID NO: 1851 - protein, 28 aa, Artificial Sequence
  Description of Artificial Sequence: Synthetic peptide
  N-term acetylated
  C-term amidated
DDPKLYDKDLGSAVWDTVVGWVDAATSL

SEQ ID NO: 1852 - protein, 28 aa, Artificial Sequence
  Description of Artificial Sequence: Synthetic peptide
  N-term acetylated
DDPKLYDKDLGSAVWDTVVGWVDAATSL

SEQ ID NO: 1853 - protein, 28 aa, Artificial Sequence
  Description of Artificial Sequence: Synthetic peptide
  N-term acetylated
  C-term amidated
DDPKLYDKDLGSAVWDTVVGWLDAAWSL

SEQ ID NO: 1854 - protein, 28 aa, Artificial Sequence
  Description of Artificial Sequence: Synthetic peptide
  N-term acetylated
DDPKLYDKDLGSAVWDTVVGWLDAAWSL

SEQ ID NO: 1855 - protein, 28 aa, Artificial Sequence
  Description of Artificial Sequence: Synthetic peptide
  N-term acetylated
  C-term amidated
DDPKLYDKDLGSAVWDTVVGWLDAATSL

SEQ ID NO: 1856 - protein, 28 aa, Artificial Sequence
  Description of Artificial Sequence: Synthetic peptide
  N-term acetylated
DDPKLYDKDLGSAVWDTVVGWLDAATSL

SEQ ID NO: 1857 - protein, 28 aa, Artificial Sequence
  Description of Artificial Sequence: Synthetic peptide
  N-term acetylated
  C-term amidated
DDPKLYDKDLGSAVWDTVVGWMDAAWSL

SEQ ID NO: 1858 - protein, 28 aa, Artificial Sequence
  Description of Artificial Sequence: Synthetic peptide
  N-term acetylated
DDPKLYDKDLGSAVWDTVVGWMDAAWSL

SEQ ID NO: 1859 - protein, 28 aa, Artificial Sequence
  Description of Artificial Sequence: Synthetic peptide
  N-term acetylated
  C-term amidated
DDPKLYDKDLGSAVWDTVVGWMDAATSL

SEQ ID NO: 1860 - protein, 28 aa, Artificial Sequence
  Description of Artificial Sequence: Synthetic peptide
  N-term acetylated
DDPKLYDKDLGSAVWDTVVGWMDAATSL

SEQ ID NO: 1861 - protein, 28 aa, Artificial Sequence
  Description of Artificial Sequence: Synthetic peptide
  N-term acetylated
  C-term amidated
DDPKLYDKDLGSAVWDTVVGQVDAAWSL

SEQ ID NO: 1862 - protein, 28 aa, Artificial Sequence
  Description of Artificial Sequence: Synthetic peptide
  N-term acetylated
DDPKLYDKDLGSAVWDTVVGQVDAAWSL

SEQ ID NO: 1863 - protein, 28 aa, Artificial Sequence
  Description of Artificial Sequence: Synthetic peptide
  N-term acetylated
  C-term amidated
DDPKLYDKDLGSAVWDTVVGQVDAATSL

SEQ ID NO: 1864 - protein, 28 aa, Artificial Sequence
  Description of Artificial Sequence: Synthetic peptide
  N-term acetylated
DDPKLYDKDLGSAVWDTVVGQVDAATSL

SEQ ID NO: 1865 - protein, 28 aa, Artificial Sequence
  Description of Artificial Sequence: Synthetic peptide
  N-term acetylated
  C-term amidated
DDPKLYDKDLGSAVWDTVVGQLDAAWSL

SEQ ID NO: 1866 - protein, 28 aa, Artificial Sequence
  Description of Artificial Sequence: Synthetic peptide
  N-term acetylated
DDPKLYDKDLGSAVWDTVVGQLDAAWSL

SEQ ID NO: 1867 - protein, 28 aa, Artificial Sequence
  Description of Artificial Sequence: Synthetic peptide
  N-term acetylated
  C-term amidated
DDPKLYDKDLGSAVWDTVVGQLDAATSL

SEQ ID NO: 1868 - protein, 28 aa, Artificial Sequence
  Description of Artificial Sequence: Synthetic peptide
  N-term acetylated
DDPKLYDKDLGSAVWDTVVGQLDAATSL

SEQ ID NO: 1869 - protein, 28 aa, Artificial Sequence
  Description of Artificial Sequence: Synthetic peptide
  N-term acetylated
  C-term amidated
DDPKLYDKDLGSAVWDTVVGQMDAAWSL

SEQ ID NO: 1870 - protein, 28 aa, Artificial Sequence
  Description of Artificial Sequence: Synthetic peptide
  N-term acetylated
DDPKLYDKDLGSAVWDTVVGQMDAAWSL

SEQ ID NO: 1871 - protein, 28 aa, Artificial Sequence
  Description of Artificial Sequence: Synthetic peptide
  N-term acetylated
  C-term amidated
DDPKLYDKDLGSAVWDTVVGQMDAATSL

SEQ ID NO: 1872 - protein, 28 aa, Artificial Sequence
  Description of Artificial Sequence: Synthetic peptide
  N-term acetylated
DDPKLYDKDLGSAVWDTVVGQMDAATSL

SEQ ID NO: 1873 - protein, 28 aa, Artificial Sequence
  Description of Artificial Sequence: Synthetic peptide
  N-term acetylated
  C-term amidated
DDPKLYDKDLGSAVTDWVVAWVDAAWSL

SEQ ID NO: 1874 - protein, 28 aa, Artificial Sequence
  Description of Artificial Sequence: Synthetic peptide
  N-term acetylated
DDPKLYDKDLGSAVTDWVVAWVDAAWSL

SEQ ID NO: 1875 - protein, 28 aa, Artificial Sequence
  Description of Artificial Sequence: Synthetic peptide
  N-term acetylated
  C-term amidated
DDPKLYDKDLGSAVTDWVVAWVDAATSL

SEQ ID NO: 1876 - protein, 28 aa, Artificial Sequence
  Description of Artificial Sequence: Synthetic peptide
  N-term acetylated
DDPKLYDKDLGSAVTDWVVAWVDAATSL

SEQ ID NO: 1877 - protein, 28 aa, Artificial Sequence
  Description of Artificial Sequence: Synthetic peptide
  N-term acetylated
  C-term amidated
DDPKLYDKDLGSAVTDWVVAWLDAAWSL

SEQ ID NO: 1878 - protein, 28 aa, Artificial Sequence
  Description of Artificial Sequence: Synthetic peptide
  N-term acetylated
DDPKLYDKDLGSAVTDWVVAWLDAAWSL

SEQ ID NO: 1879 - protein, 28 aa, Artificial Sequence
  Description of Artificial Sequence: Synthetic peptide
  N-term acetylated
  C-term amidated
DDPKLYDKDLGSAVTDWVVAWLDAATSL

SEQ ID NO: 1880 - protein, 28 aa, Artificial Sequence
  Description of Artificial Sequence: Synthetic peptide
  N-term acetylated
DDPKLYDKDLGSAVTDWVVAWLDAATSL

SEQ ID NO: 1881 - protein, 28 aa, Artificial Sequence
  Description of Artificial Sequence: Synthetic peptide
  N-term acetylated
  C-term amidated
DDPKLYDKDLGSAVTDWVVAWMDAAWSL

SEQ ID NO: 1882 - protein, 28 aa, Artificial Sequence
  Description of Artificial Sequence: Synthetic peptide
  N-term acetylated
DDPKLYDKDLGSAVTDWVVAWMDAAWSL

SEQ ID NO: 1883 - protein, 28 aa, Artificial Sequence
  Description of Artificial Sequence: Synthetic peptide
  N-term acetylated
  C-term amidated
DDPKLYDKDLGSAVTDWVVAWMDAATSL

SEQ ID NO: 1884 - protein, 28 aa, Artificial Sequence
  Description of Artificial Sequence: Synthetic peptide
  N-term acetylated
DDPKLYDKDLGSAVTDWVVAWMDAATSL

SEQ ID NO: 1885 - protein, 28 aa, Artificial Sequence
  Description of Artificial Sequence: Synthetic peptide
  N-term acetylated
  C-term amidated
DDPKLYDKDLGSAVTDWVVAQVDAAWSL

SEQ ID NO: 1886 - protein, 28 aa, Artificial Sequence
  Description of Artificial Sequence: Synthetic peptide
  N-term acetylated
DDPKLYDKDLGSAVTDWVVAQVDAAWSL

SEQ ID NO: 1887 - protein, 28 aa, Artificial Sequence
  Description of Artificial Sequence: Synthetic peptide
  N-term acetylated
  C-term amidated
DDPKLYDKDLGSAVTDWVVAQVDAATSL

SEQ ID NO: 1888 - protein, 28 aa, Artificial Sequence
  Description of Artificial Sequence: Synthetic peptide
  N-term acetylated
DDPKLYDKDLGSAVTDWVVAQVDAATSL

SEQ ID NO: 1889 - protein, 28 aa, Artificial Sequence
  Description of Artificial Sequence: Synthetic peptide
  N-term acetylated
  C-term amidated
DDPKLYDKDLGSAVTDWVVAQLDAAWSL

SEQ ID NO: 1890 - protein, 28 aa, Artificial Sequence
  Description of Artificial Sequence: Synthetic peptide
  N-term acetylated
DDPKLYDKDLGSAVTDWVVAQLDAAWSL

SEQ ID NO: 1891 - protein, 28 aa, Artificial Sequence
  Description of Artificial Sequence: Synthetic peptide
  N-term acetylated
  C-term amidated
DDPKLYDKDLGSAVTDWVVAQLDAATSL

SEQ ID NO: 1892 - protein, 28 aa, Artificial Sequence
  Description of Artificial Sequence: Synthetic peptide
  N-term acetylated
DDPKLYDKDLGSAVTDWVVAQLDAATSL

SEQ ID NO: 1893 - protein, 28 aa, Artificial Sequence
  Description of Artificial Sequence: Synthetic peptide
  N-term acetylated
  C-term amidated
DDPKLYDKDLGSAVTDWVVAQMDAAWSL

SEQ ID NO: 1894 - protein, 28 aa, Artificial Sequence
  Description of Artificial Sequence: Synthetic peptide
  N-term acetylated
DDPKLYDKDLGSAVTDWVVAQMDAAWSL

SEQ ID NO: 1895 - protein, 28 aa, Artificial Sequence
  Description of Artificial Sequence: Synthetic peptide
  N-term acetylated
  C-term amidated
DDPKLYDKDLGSAVTDWVVAQMDAATSL

SEQ ID NO: 1896 - protein, 28 aa, Artificial Sequence
  Description of Artificial Sequence: Synthetic peptide
  N-term acetylated
DDPKLYDKDLGSAVTDWVVAQMDAATSL

SEQ ID NO: 1897 - protein, 28 aa, Artificial Sequence
  Description of Artificial Sequence: Synthetic peptide
  N-term acetylated
  C-term amidated
DDPKLYDKDLGSAVTDWVVGWVDAAWSL

SEQ ID NO: 1898 - protein, 28 aa, Artificial Sequence
  Description of Artificial Sequence: Synthetic peptide
  N-term acetylated
DDPKLYDKDLGSAVTDWVVGWVDAAWSL

SEQ ID NO: 1899 - protein, 28 aa, Artificial Sequence
  Description of Artificial Sequence: Synthetic peptide
  N-term acetylated
  C-term amidated
DDPKLYDKDLGSAVTDWVVGWVDAATSL

SEQ ID NO: 1900 - protein, 28 aa, Artificial Sequence
  Description of Artificial Sequence: Synthetic peptide
  N-term acetylated
DDPKLYDKDLGSAVTDWVVGWVDAATSL

SEQ ID NO: 1901 - protein, 28 aa, Artificial Sequence
  Description of Artificial Sequence: Synthetic peptide
  N-term acetylated
  C-term amidated
DDPKLYDKDLGSAVTDWVVGWLDAAWSL

SEQ ID NO: 1902 - protein, 28 aa, Artificial Sequence
  Description of Artificial Sequence: Synthetic peptide
  N-term acetylated
DDPKLYDKDLGSAVTDWVVGWLDAAWSL

SEQ ID NO: 1903 - protein, 28 aa, Artificial Sequence
  Description of Artificial Sequence: Synthetic peptide
  N-term acetylated
  C-term amidated
DDPKLYDKDLGSAVTDWVVGWLDAATSL

SEQ ID NO: 1904 - protein, 28 aa, Artificial Sequence
  Description of Artificial Sequence: Synthetic peptide
  N-term acetylated
DDPKLYDKDLGSAVTDWVVGWLDAATSL

SEQ ID NO: 1905 - protein, 28 aa, Artificial Sequence
  Description of Artificial Sequence: Synthetic peptide
  N-term acetylated
  C-term amidated
DDPKLYDKDLGSAVTDWVVGWMDAAWSL

SEQ ID NO: 1906 - protein, 28 aa, Artificial Sequence
  Description of Artificial Sequence: Synthetic peptide
  N-term acetylated
DDPKLYDKDLGSAVTDWVVGWMDAAWSL

SEQ ID NO: 1907 - protein, 28 aa, Artificial Sequence
  Description of Artificial Sequence: Synthetic peptide
  N-term acetylated
  C-term amidated
DDPKLYDKDLGSAVTDWVVGWMDAATSL

SEQ ID NO: 1908 - protein, 28 aa, Artificial Sequence
  Description of Artificial Sequence: Synthetic peptide
  N-term acetylated
DDPKLYDKDLGSAVTDWVVGWMDAATSL

SEQ ID NO: 1909 - protein, 28 aa, Artificial Sequence
  Description of Artificial Sequence: Synthetic peptide
  N-term acetylated
  C-term amidated
DDPKLYDKDLGSAVTDWVVGQVDAAWSL

SEQ ID NO: 1910 - protein, 28 aa, Artificial Sequence
  Description of Artificial Sequence: Synthetic peptide
  N-term acetylated
DDPKLYDKDLGSAVTDWVVGQVDAAWSL

SEQ ID NO: 1911 - protein, 28 aa, Artificial Sequence
  Description of Artificial Sequence: Synthetic peptide
  N-term acetylated
  C-term amidated
DDPKLYDKDLGSAVTDWVVGQVDAATSL

SEQ ID NO: 1912 - protein, 28 aa, Artificial Sequence
  Description of Artificial Sequence: Synthetic peptide
  N-term acetylated
DDPKLYDKDLGSAVTDWVVGQVDAATSL

SEQ ID NO: 1913 - protein, 28 aa, Artificial Sequence
  Description of Artificial Sequence: Synthetic peptide
  N-term acetylated
  C-term amidated
DDPKLYDKDLGSAVTDWVVGQLDAAWSL

SEQ ID NO: 1914 - protein, 28 aa, Artificial Sequence
  Description of Artificial Sequence: Synthetic peptide
  N-term acetylated
DDPKLYDKDLGSAVTDWVVGQLDAAWSL

SEQ ID NO: 1915 - protein, 28 aa, Artificial Sequence
  Description of Artificial Sequence: Synthetic peptide
  N-term acetylated
  C-term amidated
DDPKLYDKDLGSAVTDWVVGQLDAATSL

SEQ ID NO: 1916 - protein, 28 aa, Artificial Sequence
  Description of Artificial Sequence: Synthetic peptide
  N-term acetylated
DDPKLYDKDLGSAVTDWVVGQLDAATSL

SEQ ID NO: 1917 - protein, 28 aa, Artificial Sequence
  Description of Artificial Sequence: Synthetic peptide
  N-term acetylated
  C-term amidated
DDPKLYDKDLGSAVTDWVVGQMDAAWSL

SEQ ID NO: 1918 - protein, 28 aa, Artificial Sequence
  Description of Artificial Sequence: Synthetic peptide
  N-term acetylated
DDPKLYDKDLGSAVTDWVVGQMDAAWSL

SEQ ID NO: 1919 - protein, 28 aa, Artificial Sequence
  Description of Artificial Sequence: Synthetic peptide
  N-term acetylated
  C-term amidated
DDPKLYDKDLGSAVTDWVVGQMDAATSL

SEQ ID NO: 1920 - protein, 28 aa, Artificial Sequence
  Description of Artificial Sequence: Synthetic peptide
  N-term acetylated
DDPKLYDKDLGSAVTDWVVGQMDAATSL

SEQ ID NO: 1921 - protein, 28 aa, Artificial Sequence
  Description of Artificial Sequence: Synthetic peptide
  N-term acetylated
  C-term amidated
DDPKLYDKDLGSAVTDTVVAWVDAAWSL

SEQ ID NO: 1922 - protein, 28 aa, Artificial Sequence
  Description of Artificial Sequence: Synthetic peptide
  N-term acetylated
DDPKLYDKDLGSAVTDTVVAWVDAAWSL

SEQ ID NO: 1923 - protein, 28 aa, Artificial Sequence
  Description of Artificial Sequence: Synthetic peptide
  N-term acetylated
  C-term amidated
DDPKLYDKDLGSAVTDTVVAWVDAATSL

SEQ ID NO: 1924 - protein, 28 aa, Artificial Sequence
  Description of Artificial Sequence: Synthetic peptide
  N-term acetylated
DDPKLYDKDLGSAVTDTVVAWVDAATSL

SEQ ID NO: 1925 - protein, 28 aa, Artificial Sequence
  Description of Artificial Sequence: Synthetic peptide
  N-term acetylated
  C-term amidated
DDPKLYDKDLGSAVTDTVVAWLDAAWSL

SEQ ID NO: 1926 - protein, 28 aa, Artificial Sequence
  Description of Artificial Sequence: Synthetic peptide
  N-term acetylated
DDPKLYDKDLGSAVTDTVVAWLDAAWSL

SEQ ID NO: 1927 - protein, 28 aa, Artificial Sequence
  Description of Artificial Sequence: Synthetic peptide
  N-term acetylated
  C-term amidated
DDPKLYDKDLGSAVTDTVVAWLDAATSL

SEQ ID NO: 1928 - protein, 28 aa, Artificial Sequence
  Description of Artificial Sequence: Synthetic peptide
  N-term acetylated
DDPKLYDKDLGSAVTDTVVAWLDAATSL

SEQ ID NO: 1929 - protein, 28 aa, Artificial Sequence
  Description of Artificial Sequence: Synthetic peptide
  N-term acetylated
  C-term amidated
DDPKLYDKDLGSAVTDTVVAWMDAAWSL

SEQ ID NO: 1930 - protein, 28 aa, Artificial Sequence
  Description of Artificial Sequence: Synthetic peptide
  N-term acetylated
DDPKLYDKDLGSAVTDTVVAWMDAAWSL

SEQ ID NO: 1931 - protein, 28 aa, Artificial Sequence
  Description of Artificial Sequence: Synthetic peptide
  N-term acetylated
  C-term amidated
DDPKLYDKDLGSAVTDTVVAWMDAATSL

SEQ ID NO: 1932 - protein, 28 aa, Artificial Sequence
  Description of Artificial Sequence: Synthetic peptide
  N-term acetylated
DDPKLYDKDLGSAVTDTVVAWMDAATSL

SEQ ID NO: 1933 - protein, 28 aa, Artificial Sequence
  Description of Artificial Sequence: Synthetic peptide
  N-term acetylated
  C-term amidated
DDPKLYDKDLGSAVTDTVVAQVDAAWSL

SEQ ID NO: 1934 - protein, 28 aa, Artificial Sequence
  Description of Artificial Sequence: Synthetic peptide
  N-term acetylated
DDPKLYDKDLGSAVTDTVVAQVDAAWSL

SEQ ID NO: 1935 - protein, 28 aa, Artificial Sequence
  Description of Artificial Sequence: Synthetic peptide
  N-term acetylated
  C-term amidated
DDPKLYDKDLGSAVTDTVVAQVDAATSL

SEQ ID NO: 1936 - protein, 28 aa, Artificial Sequence
  Description of Artificial Sequence: Synthetic peptide
  N-term acetylated
DDPKLYDKDLGSAVTDTVVAQVDAATSL

SEQ ID NO: 1937 - protein, 28 aa, Artificial Sequence
  Description of Artificial Sequence: Synthetic peptide
  N-term acetylated
  C-term amidated
DDPKLYDKDLGSAVTDTVVAQLDAAWSL

SEQ ID NO: 1938 - protein, 28 aa, Artificial Sequence
  Description of Artificial Sequence: Synthetic peptide
  N-term acetylated
DDPKLYDKDLGSAVTDTVVAQLDAAWSL

SEQ ID NO: 1939 - protein, 28 aa, Artificial Sequence
  Description of Artificial Sequence: Synthetic peptide
  N-term acetylated
  C-term amidated
DDPKLYDKDLGSAVTDTVVAQLDAATSL

SEQ ID NO: 1940 - protein, 28 aa, Artificial Sequence
  Description of Artificial Sequence: Synthetic peptide
  N-term acetylated
DDPKLYDKDLGSAVTDTVVAQLDAATSL

SEQ ID NO: 1941 - protein, 28 aa, Artificial Sequence
  Description of Artificial Sequence: Synthetic peptide
  N-term acetylated
  C-term amidated
DDPKLYDKDLGSAVTDTVVAQMDAAWSL

SEQ ID NO: 1942 - protein, 28 aa, Artificial Sequence
  Description of Artificial Sequence: Synthetic peptide
  N-term acetylated
DDPKLYDKDLGSAVTDTVVAQMDAAWSL

SEQ ID NO: 1943 - protein, 28 aa, Artificial Sequence
  Description of Artificial Sequence: Synthetic peptide
  N-term acetylated
  C-term amidated
DDPKLYDKDLGSAVTDTVVAQMDAATSL

SEQ ID NO: 1944 - protein, 28 aa, Artificial Sequence
  Description of Artificial Sequence: Synthetic peptide
  N-term acetylated
DDPKLYDKDLGSAVTDTVVAQMDAATSL

SEQ ID NO: 1945 - protein, 28 aa, Artificial Sequence
  Description of Artificial Sequence: Synthetic peptide
  N-term acetylated
  C-term amidated
DDPKLYDKDLGSAVTDTVVGWVDAAWSL

SEQ ID NO: 1946 - protein, 28 aa, Artificial Sequence
  Description of Artificial Sequence: Synthetic peptide
  N-term acetylated
DDPKLYDKDLGSAVTDTVVGWVDAAWSL

SEQ ID NO: 1947 - protein, 28 aa, Artificial Sequence
  Description of Artificial Sequence: Synthetic peptide
  N-term acetylated
  C-term amidated
DDPKLYDKDLGSAVTDTVVGWVDAATSL

SEQ ID NO: 1948 - protein, 28 aa, Artificial Sequence
  Description of Artificial Sequence: Synthetic peptide
  N-term acetylated
DDPKLYDKDLGSAVTDTVVGWVDAATSL

SEQ ID NO: 1949 - protein, 28 aa, Artificial Sequence
  Description of Artificial Sequence: Synthetic peptide
  N-term acetylated
  C-term amidated
DDPKLYDKDLGSAVTDTVVGWLDAAWSL

SEQ ID NO: 1950 - protein, 28 aa, Artificial Sequence
  Description of Artificial Sequence: Synthetic peptide
  N-term acetylated
DDPKLYDKDLGSAVTDTVVGWLDAAWSL

SEQ ID NO: 1951 - protein, 28 aa, Artificial Sequence
  Description of Artificial Sequence: Synthetic peptide
  N-term acetylated
  C-term amidated
DDPKLYDKDLGSAVTDTVVGWLDAATSL

SEQ ID NO: 1952 - protein, 28 aa, Artificial Sequence
  Description of Artificial Sequence: Synthetic peptide
  N-term acetylated
DDPKLYDKDLGSAVTDTVVGWLDAATSL

SEQ ID NO: 1953 - protein, 28 aa, Artificial Sequence
  Description of Artificial Sequence: Synthetic peptide
  N-term acetylated
  C-term amidated
DDPKLYDKDLGSAVTDTVVGWMDAAWSL

SEQ ID NO: 1954 - protein, 28 aa, Artificial Sequence
  Description of Artificial Sequence: Synthetic peptide
  N-term acetylated
DDPKLYDKDLGSAVTDTVVGWMDAAWSL

SEQ ID NO: 1955 - protein, 28 aa, Artificial Sequence
  Description of Artificial Sequence: Synthetic peptide
  N-term acetylated
  C-term amidated
DDPKLYDKDLGSAVTDTVVGWMDAATSL

SEQ ID NO: 1956 - protein, 28 aa, Artificial Sequence
  Description of Artificial Sequence: Synthetic peptide
  N-term acetylated
DDPKLYDKDLGSAVTDTVVGWMDAATSL

SEQ ID NO: 1957 - protein, 28 aa, Artificial Sequence
  Description of Artificial Sequence: Synthetic peptide
  N-term acetylated
  C-term amidated
DDPKLYDKDLGSAVTDTVVGQVDAAWSL

SEQ ID NO: 1958 - protein, 28 aa, Artificial Sequence
  Description of Artificial Sequence: Synthetic peptide
  N-term acetylated
DDPKLYDKDLGSAVTDTVVGQVDAAWSL

SEQ ID NO: 1959 - protein, 28 aa, Artificial Sequence
  Description of Artificial Sequence: Synthetic peptide
  N-term acetylated
  C-term amidated
DDPKLYDKDLGSAVTDTVVGQVDAATSL

SEQ ID NO: 1960 - protein, 28 aa, Artificial Sequence
  Description of Artificial Sequence: Synthetic peptide
  N-term acetylated
DDPKLYDKDLGSAVTDTVVGQVDAATSL

SEQ ID NO: 1961 - protein, 28 aa, Artificial Sequence
  Description of Artificial Sequence: Synthetic peptide
  N-term acetylated
  C-term amidated
DDPKLYDKDLGSAVTDTVVGQLDAAWSL

SEQ ID NO: 1962 - protein, 28 aa, Artificial Sequence
  Description of Artificial Sequence: Synthetic peptide
  N-term acetylated
DDPKLYDKDLGSAVTDTVVGQLDAAWSL

SEQ ID NO: 1963 - protein, 28 aa, Artificial Sequence
  Description of Artificial Sequence: Synthetic peptide
  N-term acetylated
  C-term amidated
DDPKLYDKDLGSAVTDTVVGQLDAATSL

SEQ ID NO: 1964 - protein, 28 aa, Artificial Sequence
  Description of Artificial Sequence: Synthetic peptide
  N-term acetylated
DDPKLYDKDLGSAVTDTVVGQLDAATSL

SEQ ID NO: 1965 - protein, 28 aa, Artificial Sequence
  Description of Artificial Sequence: Synthetic peptide
  N-term acetylated
  C-term amidated
DDPKLYDKDLGSAVTDTVVGQMDAAWSL

SEQ ID NO: 1966 - protein, 28 aa, Artificial Sequence
  Description of Artificial Sequence: Synthetic peptide
  N-term acetylated
DDPKLYDKDLGSAVTDTVVGQMDAAWSL

SEQ ID NO: 1967 - protein, 28 aa, Artificial Sequence
  Description of Artificial Sequence: Synthetic peptide
  N-term acetylated
  C-term amidated
DDPKLYDKDLGSAVTDTVVGQMDAATSL

SEQ ID NO: 1968 - protein, 28 aa, Artificial Sequence
  Description of Artificial Sequence: Synthetic peptide
  N-term acetylated
DDPKLYDKDLGSAVTDTVVGQMDAATSL

SEQ ID NO: 1969 - protein, 28 aa, Artificial Sequence
  Description of Artificial Sequence: Synthetic peptide
  N-term acetylated
  C-term amidated
DDPKLYDKDLGSAVGDWVVAWVDAAWSL

SEQ ID NO: 1970 - protein, 28 aa, Artificial Sequence
  Description of Artificial Sequence: Synthetic peptide
  N-term acetylated
DDPKLYDKDLGSAVGDWVVAWVDAAWSL

SEQ ID NO: 1971 - protein, 28 aa, Artificial Sequence
  Description of Artificial Sequence: Synthetic peptide
  N-term acetylated
  C-term amidated
DDPKLYDKDLGSAVGDWVVAWVDAATSL

SEQ ID NO: 1972 - protein, 28 aa, Artificial Sequence
  Description of Artificial Sequence: Synthetic peptide
  N-term acetylated
DDPKLYDKDLGSAVGDWVVAWVDAATSL

SEQ ID NO: 1973 - protein, 28 aa, Artificial Sequence
  Description of Artificial Sequence: Synthetic peptide
  N-term acetylated
  C-term amidated
DDPKLYDKDLGSAVGDWVVAWLDAAWSL

SEQ ID NO: 1974 - protein, 28 aa, Artificial Sequence
  Description of Artificial Sequence: Synthetic peptide
  N-term acetylated
DDPKLYDKDLGSAVGDWVVAWLDAAWSL

SEQ ID NO: 1975 - protein, 28 aa, Artificial Sequence
  Description of Artificial Sequence: Synthetic peptide
  N-term acetylated
  C-term amidated
DDPKLYDKDLGSAVGDWVVAWLDAATSL

SEQ ID NO: 1976 - protein, 28 aa, Artificial Sequence
  Description of Artificial Sequence: Synthetic peptide
  N-term acetylated
DDPKLYDKDLGSAVGDWVVAWLDAATSL

SEQ ID NO: 1977 - protein, 28 aa, Artificial Sequence
  Description of Artificial Sequence: Synthetic peptide
  N-term acetylated
  C-term amidated
DDPKLYDKDLGSAVGDWVVAWMDAAWSL

SEQ ID NO: 1978 - protein, 28 aa, Artificial Sequence
  Description of Artificial Sequence: Synthetic peptide
  N-term acetylated
DDPKLYDKDLGSAVGDWVVAWMDAAWSL

SEQ ID NO: 1979 - protein, 28 aa, Artificial Sequence
  Description of Artificial Sequence: Synthetic peptide
  N-term acetylated
  C-term amidated
DDPKLYDKDLGSAVGDWVVAWMDAATSL

SEQ ID NO: 1980 - protein, 28 aa, Artificial Sequence
  Description of Artificial Sequence: Synthetic peptide
  N-term acetylated
DDPKLYDKDLGSAVGDWVVAWMDAATSL

SEQ ID NO: 1981 - protein, 28 aa, Artificial Sequence
  Description of Artificial Sequence: Synthetic peptide
  N-term acetylated
  C-term amidated
DDPKLYDKDLGSAVGDWVVAQVDAAWSL

SEQ ID NO: 1982 - protein, 28 aa, Artificial Sequence
  Description of Artificial Sequence: Synthetic peptide
  N-term acetylated
DDPKLYDKDLGSAVGDWVVAQVDAAWSL

SEQ ID NO: 1983 - protein, 28 aa, Artificial Sequence
  Description of Artificial Sequence: Synthetic peptide
  N-term acetylated
  C-term amidated
DDPKLYDKDLGSAVGDWVVAQVDAATSL

SEQ ID NO: 1984 - protein, 28 aa, Artificial Sequence
  Description of Artificial Sequence: Synthetic peptide
  N-term acetylated
DDPKLYDKDLGSAVGDWVVAQVDAATSL

SEQ ID NO: 1985 - protein, 28 aa, Artificial Sequence
  Description of Artificial Sequence: Synthetic peptide
  N-term acetylated
  C-term amidated
DDPKLYDKDLGSAVGDWVVAQLDAAWSL

SEQ ID NO: 1986 - protein, 28 aa, Artificial Sequence
  Description of Artificial Sequence: Synthetic peptide
  N-term acetylated
DDPKLYDKDLGSAVGDWVVAQLDAAWSL

SEQ ID NO: 1987 - protein, 28 aa, Artificial Sequence
  Description of Artificial Sequence: Synthetic peptide
  N-term acetylated
  C-term amidated
DDPKLYDKDLGSAVGDWVVAQLDAATSL

SEQ ID NO: 1988 - protein, 28 aa, Artificial Sequence
  Description of Artificial Sequence: Synthetic peptide
  N-term acetylated
DDPKLYDKDLGSAVGDWVVAQLDAATSL

SEQ ID NO: 1989 - protein, 28 aa, Artificial Sequence
  Description of Artificial Sequence: Synthetic peptide
  N-term acetylated
  C-term amidated
DDPKLYDKDLGSAVGDWVVAQMDAAWSL

SEQ ID NO: 1990 - protein, 28 aa, Artificial Sequence
  Description of Artificial Sequence: Synthetic peptide
  N-term acetylated
DDPKLYDKDLGSAVGDWVVAQMDAAWSL

SEQ ID NO: 1991 - protein, 28 aa, Artificial Sequence
  Description of Artificial Sequence: Synthetic peptide
  N-term acetylated
  C-term amidated
DDPKLYDKDLGSAVGDWVVAQMDAATSL

SEQ ID NO: 1992 - protein, 28 aa, Artificial Sequence
  Description of Artificial Sequence: Synthetic peptide
  N-term acetylated
DDPKLYDKDLGSAVGDWVVAQMDAATSL

SEQ ID NO: 1993 - protein, 28 aa, Artificial Sequence
  Description of Artificial Sequence: Synthetic peptide
  N-term acetylated
  C-term amidated
DDPKLYDKDLGSAVGDWVVGWVDAAWSL

SEQ ID NO: 1994 - protein, 28 aa, Artificial Sequence
  Description of Artificial Sequence: Synthetic peptide
  N-term acetylated
DDPKLYDKDLGSAVGDWVVGWVDAAWSL

SEQ ID NO: 1995 - protein, 28 aa, Artificial Sequence
  Description of Artificial Sequence: Synthetic peptide
  N-term acetylated
  C-term amidated
DDPKLYDKDLGSAVGDWVVGWVDAATSL

SEQ ID NO: 1996 - protein, 28 aa, Artificial Sequence
  Description of Artificial Sequence: Synthetic peptide
  N-term acetylated
DDPKLYDKDLGSAVGDWVVGWVDAATSL

SEQ ID NO: 1997 - protein, 28 aa, Artificial Sequence
  Description of Artificial Sequence: Synthetic peptide
  N-term acetylated
  C-term amidated
DDPKLYDKDLGSAVGDWVVGWLDAAWSL

SEQ ID NO: 1998 - protein, 28 aa, Artificial Sequence
  Description of Artificial Sequence: Synthetic peptide
  N-term acetylated
DDPKLYDKDLGSAVGDWVVGWLDAAWSL

SEQ ID NO: 1999 - protein, 28 aa, Artificial Sequence
  Description of Artificial Sequence: Synthetic peptide
  N-term acetylated
  C-term amidated
DDPKLYDKDLGSAVGDWVVGWLDAATSL

SEQ ID NO: 2000 - protein, 28 aa, Artificial Sequence
  Description of Artificial Sequence: Synthetic peptide
  N-term acetylated
DDPKLYDKDLGSAVGDWVVGWLDAATSL

SEQ ID NO: 2001 - protein, 28 aa, Artificial Sequence
  Description of Artificial Sequence: Synthetic peptide
  N-term acetylated
  C-term amidated
DDPKLYDKDLGSAVGDWVVGWMDAAWSL

SEQ ID NO: 2002 - protein, 28 aa, Artificial Sequence
  Description of Artificial Sequence: Synthetic peptide
  N-term acetylated
DDPKLYDKDLGSAVGDWVVGWMDAAWSL

SEQ ID NO: 2003 - protein, 28 aa, Artificial Sequence
  Description of Artificial Sequence: Synthetic peptide
  N-term acetylated
  C-term amidated
DDPKLYDKDLGSAVGDWVVGWMDAATSL

SEQ ID NO: 2004 - protein, 28 aa, Artificial Sequence
  Description of Artificial Sequence: Synthetic peptide
  N-term acetylated
DDPKLYDKDLGSAVGDWVVGWMDAATSL

SEQ ID NO: 2005 - protein, 28 aa, Artificial Sequence
  Description of Artificial Sequence: Synthetic peptide
  N-term acetylated
  C-term amidated
DDPKLYDKDLGSAVGDWVVGQVDAAWSL

SEQ ID NO: 2006 - protein, 28 aa, Artificial Sequence
  Description of Artificial Sequence: Synthetic peptide
  N-term acetylated
DDPKLYDKDLGSAVGDWVVGQVDAAWSL

SEQ ID NO: 2007 - protein, 28 aa, Artificial Sequence
  Description of Artificial Sequence: Synthetic peptide
  N-term acetylated
  C-term amidated
DDPKLYDKDLGSAVGDWVVGQVDAATSL

SEQ ID NO: 2008 - protein, 28 aa, Artificial Sequence
  Description of Artificial Sequence: Synthetic peptide
  N-term acetylated
DDPKLYDKDLGSAVGDWVVGQVDAATSL

SEQ ID NO: 2009 - protein, 28 aa, Artificial Sequence
  Description of Artificial Sequence: Synthetic peptide
  N-term acetylated
  C-term amidated
DDPKLYDKDLGSAVGDWVVGQLDAAWSL

SEQ ID NO: 2010 - protein, 28 aa, Artificial Sequence
  Description of Artificial Sequence: Synthetic peptide
  N-term acetylated
DDPKLYDKDLGSAVGDWVVGQLDAAWSL

SEQ ID NO: 2011 - protein, 28 aa, Artificial Sequence
  Description of Artificial Sequence: Synthetic peptide
  N-term acetylated
  C-term amidated
DDPKLYDKDLGSAVGDWVVGQLDAATSL

SEQ ID NO: 2012 - protein, 28 aa, Artificial Sequence
  Description of Artificial Sequence: Synthetic peptide
  N-term acetylated
DDPKLYDKDLGSAVGDWVVGQLDAATSL

SEQ ID NO: 2013 - protein, 28 aa, Artificial Sequence
  Description of Artificial Sequence: Synthetic peptide
  N-term acetylated
  C-term amidated
DDPKLYDKDLGSAVGDWVVGQMDAAWSL

SEQ ID NO: 2014 - protein, 28 aa, Artificial Sequence
  Description of Artificial Sequence: Synthetic peptide
  N-term acetylated
DDPKLYDKDLGSAVGDWVVGQMDAAWSL

SEQ ID NO: 2015 - protein, 28 aa, Artificial Sequence
  Description of Artificial Sequence: Synthetic peptide
  N-term acetylated
  C-term amidated
DDPKLYDKDLGSAVGDWVVGQMDAATSL

SEQ ID NO: 2016 - protein, 28 aa, Artificial Sequence
  Description of Artificial Sequence: Synthetic peptide
  N-term acetylated
DDPKLYDKDLGSAVGDWVVGQMDAATSL

SEQ ID NO: 2017 - protein, 28 aa, Artificial Sequence
  Description of Artificial Sequence: Synthetic peptide
  N-term acetylated
  C-term amidated
DDPKLYDKDLGSAVGDTVVAWVDAAWSL

SEQ ID NO: 2018 - protein, 28 aa, Artificial Sequence
  Description of Artificial Sequence: Synthetic peptide
  N-term acetylated
DDPKLYDKDLGSAVGDTVVAWVDAAWSL

SEQ ID NO: 2019 - protein, 28 aa, Artificial Sequence
  Description of Artificial Sequence: Synthetic peptide
  N-term acetylated
  C-term amidated
DDPKLYDKDLGSAVGDTVVAWVDAATSL

SEQ ID NO: 2020 - protein, 28 aa, Artificial Sequence
  Description of Artificial Sequence: Synthetic peptide
  N-term acetylated
DDPKLYDKDLGSAVGDTVVAWVDAATSL

SEQ ID NO: 2021 - protein, 28 aa, Artificial Sequence
  Description of Artificial Sequence: Synthetic peptide
  N-term acetylated
  C-term amidated
DDPKLYDKDLGSAVGDTVVAWLDAAWSL

SEQ ID NO: 2022 - protein, 28 aa, Artificial Sequence
  Description of Artificial Sequence: Synthetic peptide
  N-term acetylated
DDPKLYDKDLGSAVGDTVVAWLDAAWSL

SEQ ID NO: 2023 - protein, 28 aa, Artificial Sequence
  Description of Artificial Sequence: Synthetic peptide
  N-term acetylated
  C-term amidated
DDPKLYDKDLGSAVGDTVVAWLDAATSL

SEQ ID NO: 2024 - protein, 28 aa, Artificial Sequence
  Description of Artificial Sequence: Synthetic peptide
  N-term acetylated
DDPKLYDKDLGSAVGDTVVAWLDAATSL

SEQ ID NO: 2025 - protein, 28 aa, Artificial Sequence
  Description of Artificial Sequence: Synthetic peptide
  N-term acetylated
  C-term amidated
DDPKLYDKDLGSAVGDTVVAWMDAAWSL

SEQ ID NO: 2026 - protein, 28 aa, Artificial Sequence
  Description of Artificial Sequence: Synthetic peptide
  N-term acetylated
DDPKLYDKDLGSAVGDTVVAWMDAAWSL

SEQ ID NO: 2027 - protein, 28 aa, Artificial Sequence
  Description of Artificial Sequence: Synthetic peptide
  N-term acetylated
  C-term amidated
DDPKLYDKDLGSAVGDTVVAWMDAATSL

SEQ ID NO: 2028 - protein, 28 aa, Artificial Sequence
  Description of Artificial Sequence: Synthetic peptide
  N-term acetylated
DDPKLYDKDLGSAVGDTVVAWMDAATSL

SEQ ID NO: 2029 - protein, 28 aa, Artificial Sequence
  Description of Artificial Sequence: Synthetic peptide
  N-term acetylated
  C-term amidated
DDPKLYDKDLGSAVGDTVVAQVDAAWSL

SEQ ID NO: 2030 - protein, 28 aa, Artificial Sequence
  Description of Artificial Sequence: Synthetic peptide
  N-term acetylated
DDPKLYDKDLGSAVGDTVVAQVDAAWSL

SEQ ID NO: 2031 - protein, 28 aa, Artificial Sequence
  Description of Artificial Sequence: Synthetic peptide
  N-term acetylated
  C-term amidated
DDPKLYDKDLGSAVGDTVVAQVDAATSL

SEQ ID NO: 2032 - protein, 28 aa, Artificial Sequence
  Description of Artificial Sequence: Synthetic peptide
  N-term acetylated
DDPKLYDKDLGSAVGDTVVAQVDAATSL

SEQ ID NO: 2033 - protein, 28 aa, Artificial Sequence
  Description of Artificial Sequence: Synthetic peptide
  N-term acetylated
  C-term amidated
DDPKLYDKDLGSAVGDTVVAQLDAAWSL

SEQ ID NO: 2034 - protein, 28 aa, Artificial Sequence
  Description of Artificial Sequence: Synthetic peptide
  N-term acetylated
DDPKLYDKDLGSAVGDTVVAQLDAAWSL

SEQ ID NO: 2035 - protein, 28 aa, Artificial Sequence
  Description of Artificial Sequence: Synthetic peptide
  N-term acetylated
  C-term amidated
DDPKLYDKDLGSAVGDTVVAQLDAATSL

SEQ ID NO: 2036 - protein, 28 aa, Artificial Sequence
  Description of Artificial Sequence: Synthetic peptide
  N-term acetylated
DDPKLYDKDLGSAVGDTVVAQLDAATSL

SEQ ID NO: 2037 - protein, 28 aa, Artificial Sequence
  Description of Artificial Sequence: Synthetic peptide
  N-term acetylated
  C-term amidated
DDPKLYDKDLGSAVGDTVVAQMDAAWSL

SEQ ID NO: 2038 - protein, 28 aa, Artificial Sequence
  Description of Artificial Sequence: Synthetic peptide
  N-term acetylated
DDPKLYDKDLGSAVGDTVVAQMDAAWSL

SEQ ID NO: 2039 - protein, 28 aa, Artificial Sequence
  Description of Artificial Sequence: Synthetic peptide
  N-term acetylated
  C-term amidated
DDPKLYDKDLGSAVGDTVVAQMDAATSL

SEQ ID NO: 2040 - protein, 28 aa, Artificial Sequence
  Description of Artificial Sequence: Synthetic peptide
  N-term acetylated
DDPKLYDKDLGSAVGDTVVAQMDAATSL

SEQ ID NO: 2041 - protein, 28 aa, Artificial Sequence
  Description of Artificial Sequence: Synthetic peptide
  N-term acetylated
  C-term amidated
DDPKLYDKDLGSAVGDTVVGWVDAAWSL

SEQ ID NO: 2042 - protein, 28 aa, Artificial Sequence
  Description of Artificial Sequence: Synthetic peptide
  N-term acetylated
DDPKLYDKDLGSAVGDTVVGWVDAAWSL

SEQ ID NO: 2043 - protein, 28 aa, Artificial Sequence
  Description of Artificial Sequence: Synthetic peptide
  N-term acetylated
  C-term amidated
DDPKLYDKDLGSAVGDTVVGWVDAATSL

SEQ ID NO: 2044 - protein, 28 aa, Artificial Sequence
  Description of Artificial Sequence: Synthetic peptide
  N-term acetylated
DDPKLYDKDLGSAVGDTVVGWVDAATSL

SEQ ID NO: 2045 - protein, 28 aa, Artificial Sequence
  Description of Artificial Sequence: Synthetic peptide
  N-term acetylated
  C-term amidated
DDPKLYDKDLGSAVGDTVVGWLDAAWSL

SEQ ID NO: 2046 - protein, 28 aa, Artificial Sequence
  Description of Artificial Sequence: Synthetic peptide
  N-term acetylated
DDPKLYDKDLGSAVGDTVVGWLDAAWSL

SEQ ID NO: 2047 - protein, 28 aa, Artificial Sequence
  Description of Artificial Sequence: Synthetic peptide
  N-term acetylated
  C-term amidated
DDPKLYDKDLGSAVGDTVVGWLDAATSL

SEQ ID NO: 2048 - protein, 28 aa, Artificial Sequence
  Description of Artificial Sequence: Synthetic peptide
  N-term acetylated
DDPKLYDKDLGSAVGDTVVGWLDAATSL

SEQ ID NO: 2049 - protein, 28 aa, Artificial Sequence
  Description of Artificial Sequence: Synthetic peptide
  N-term acetylated
  C-term amidated
DDPKLYDKDLGSAVGDTVVGWMDAAWSL

SEQ ID NO: 2050 - protein, 28 aa, Artificial Sequence
  Description of Artificial Sequence: Synthetic peptide
  N-term acetylated
DDPKLYDKDLGSAVGDTVVGWMDAAWSL

SEQ ID NO: 2051 - protein, 28 aa, Artificial Sequence
  Description of Artificial Sequence: Synthetic peptide
  N-term acetylated
  C-term amidated
DDPKLYDKDLGSAVGDTVVGWMDAATSL

SEQ ID NO: 2052 - protein, 28 aa, Artificial Sequence
  Description of Artificial Sequence: Synthetic peptide
  N-term acetylated
DDPKLYDKDLGSAVGDTVVGWMDAATSL

SEQ ID NO: 2053 - protein, 28 aa, Artificial Sequence
  Description of Artificial Sequence: Synthetic peptide
  N-term acetylated
  C-term amidated
DDPKLYDKDLGSAVGDTVVGQVDAAWSL

SEQ ID NO: 2054 - protein, 28 aa, Artificial Sequence
  Description of Artificial Sequence: Synthetic peptide
  N-term acetylated
DDPKLYDKDLGSAVGDTVVGQVDAAWSL

SEQ ID NO: 2055 - protein, 28 aa, Artificial Sequence
  Description of Artificial Sequence: Synthetic peptide
  N-term acetylated
  C-term amidated
DDPKLYDKDLGSAVGDTVVGQVDAATSL

SEQ ID NO: 2056 - protein, 28 aa, Artificial Sequence
  Description of Artificial Sequence: Synthetic peptide
  N-term acetylated
DDPKLYDKDLGSAVGDTVVGQVDAATSL

SEQ ID NO: 2057 - protein, 28 aa, Artificial Sequence
  Description of Artificial Sequence: Synthetic peptide
  N-term acetylated
  C-term amidated
DDPKLYDKDLGSAVGDTVVGQLDAAWSL

SEQ ID NO: 2058 - protein, 28 aa, Artificial Sequence
  Description of Artificial Sequence: Synthetic peptide
  N-term acetylated
DDPKLYDKDLGSAVGDTVVGQLDAAWSL

SEQ ID NO: 2059 - protein, 28 aa, Artificial Sequence
  Description of Artificial Sequence: Synthetic peptide
  N-term acetylated
  C-term amidated
DDPKLYDKDLGSAVGDTVVGQLDAATSL

SEQ ID NO: 2060 - protein, 28 aa, Artificial Sequence
  Description of Artificial Sequence: Synthetic peptide
  N-term acetylated
DDPKLYDKDLGSAVGDTVVGQLDAATSL

SEQ ID NO: 2061 - protein, 28 aa, Artificial Sequence
  Description of Artificial Sequence: Synthetic peptide
  N-term acetylated
  C-term amidated
DDPKLYDKDLGSAVGDTVVGQMDAAWSL

SEQ ID NO: 2062 - protein, 28 aa, Artificial Sequence
  Description of Artificial Sequence: Synthetic peptide
  N-term acetylated
DDPKLYDKDLGSAVGDTVVGQMDAAWSL

SEQ ID NO: 2063 - protein, 28 aa, Artificial Sequence
  Description of Artificial Sequence: Synthetic peptide
  N-term acetylated
  C-term amidated
DDPKLYDKDLGSAVGDTVVGQMDAATSL

SEQ ID NO: 2064 - protein, 28 aa, Artificial Sequence
  Description of Artificial Sequence: Synthetic peptide
  N-term acetylated
DDPKLYDKDLGSAVGDTVVGQMDAATSL

SEQ ID NO: 2065 - protein, 28 aa, Artificial Sequence
  Description of Artificial Sequence: Synthetic peptide
  N-term acetylated
  C-term amidated
DDPKLYDKDLGSALWDWVVAWVDAAWSL

SEQ ID NO: 2066 - protein, 28 aa, Artificial Sequence
  Description of Artificial Sequence: Synthetic peptide
  N-term acetylated
DDPKLYDKDLGSALWDWVVAWVDAAWSL

SEQ ID NO: 2067 - protein, 28 aa, Artificial Sequence
  Description of Artificial Sequence: Synthetic peptide
  N-term acetylated
  C-term amidated
DDPKLYDKDLGSALWDWVVAWVDAATSL

SEQ ID NO: 2068 - protein, 28 aa, Artificial Sequence
  Description of Artificial Sequence: Synthetic peptide
  N-term acetylated
DDPKLYDKDLGSALWDWVVAWVDAATSL

SEQ ID NO: 2069 - protein, 28 aa, Artificial Sequence
  Description of Artificial Sequence: Synthetic peptide
  N-term acetylated
  C-term amidated
DDPKLYDKDLGSALWDWVVAWLDAAWSL

SEQ ID NO: 2070 - protein, 28 aa, Artificial Sequence
  Description of Artificial Sequence: Synthetic peptide
  N-term acetylated
DDPKLYDKDLGSALWDWVVAWLDAAWSL

SEQ ID NO: 2071 - protein, 28 aa, Artificial Sequence
  Description of Artificial Sequence: Synthetic peptide
  N-term acetylated
  C-term amidated
DDPKLYDKDLGSALWDWVVAWLDAATSL

SEQ ID NO: 2072 - protein, 28 aa, Artificial Sequence
  Description of Artificial Sequence: Synthetic peptide
  N-term acetylated
DDPKLYDKDLGSALWDWVVAWLDAATSL

SEQ ID NO: 2073 - protein, 28 aa, Artificial Sequence
  Description of Artificial Sequence: Synthetic peptide
  N-term acetylated
  C-term amidated
DDPKLYDKDLGSALWDWVVAWMDAAWSL

SEQ ID NO: 2074 - protein, 28 aa, Artificial Sequence
  Description of Artificial Sequence: Synthetic peptide
  N-term acetylated
DDPKLYDKDLGSALWDWVVAWMDAAWSL

SEQ ID NO: 2075 - protein, 28 aa, Artificial Sequence
  Description of Artificial Sequence: Synthetic peptide
  N-term acetylated
  C-term amidated
DDPKLYDKDLGSALWDWVVAWMDAATSL

SEQ ID NO: 2076 - protein, 28 aa, Artificial Sequence
  Description of Artificial Sequence: Synthetic peptide
  N-term acetylated
DDPKLYDKDLGSALWDWVVAWMDAATSL

SEQ ID NO: 2077 - protein, 28 aa, Artificial Sequence
  Description of Artificial Sequence: Synthetic peptide
  N-term acetylated
  C-term amidated
DDPKLYDKDLGSALWDWVVAQVDAAWSL

SEQ ID NO: 2078 - protein, 28 aa, Artificial Sequence
  Description of Artificial Sequence: Synthetic peptide
  N-term acetylated
DDPKLYDKDLGSALWDWVVAQVDAAWSL

SEQ ID NO: 2079 - protein, 28 aa, Artificial Sequence
  Description of Artificial Sequence: Synthetic peptide
  N-term acetylated
  C-term amidated
DDPKLYDKDLGSALWDWVVAQVDAATSL

SEQ ID NO: 2080 - protein, 28 aa, Artificial Sequence
  Description of Artificial Sequence: Synthetic peptide
  N-term acetylated
DDPKLYDKDLGSALWDWVVAQVDAATSL

SEQ ID NO: 2081 - protein, 28 aa, Artificial Sequence
  Description of Artificial Sequence: Synthetic peptide
  N-term acetylated
  C-term amidated
DDPKLYDKDLGSALWDWVVAQLDAAWSL

SEQ ID NO: 2082 - protein, 28 aa, Artificial Sequence
  Description of Artificial Sequence: Synthetic peptide
  N-term acetylated
DDPKLYDKDLGSALWDWVVAQLDAAWSL

SEQ ID NO: 2083 - protein, 28 aa, Artificial Sequence
  Description of Artificial Sequence: Synthetic peptide
  N-term acetylated
  C-term amidated
DDPKLYDKDLGSALWDWVVAQLDAATSL

SEQ ID NO: 2084 - protein, 28 aa, Artificial Sequence
  Description of Artificial Sequence: Synthetic peptide
  N-term acetylated
DDPKLYDKDLGSALWDWVVAQLDAATSL

SEQ ID NO: 2085 - protein, 28 aa, Artificial Sequence
  Description of Artificial Sequence: Synthetic peptide
  N-term acetylated
  C-term amidated
DDPKLYDKDLGSALWDWVVAQMDAAWSL

SEQ ID NO: 2086 - protein, 28 aa, Artificial Sequence
  Description of Artificial Sequence: Synthetic peptide
  N-term acetylated
DDPKLYDKDLGSALWDWVVAQMDAAWSL

SEQ ID NO: 2087 - protein, 28 aa, Artificial Sequence
  Description of Artificial Sequence: Synthetic peptide
  N-term acetylated
  C-term amidated
DDPKLYDKDLGSALWDWVVAQMDAATSL

SEQ ID NO: 2088 - protein, 28 aa, Artificial Sequence
  Description of Artificial Sequence: Synthetic peptide
  N-term acetylated
DDPKLYDKDLGSALWDWVVAQMDAATSL

SEQ ID NO: 2089 - protein, 28 aa, Artificial Sequence
  Description of Artificial Sequence: Synthetic peptide
  N-term acetylated
  C-term amidated
DDPKLYDKDLGSALWDWVVGWVDAAWSL

SEQ ID NO: 2090 - protein, 28 aa, Artificial Sequence
  Description of Artificial Sequence: Synthetic peptide
  N-term acetylated
DDPKLYDKDLGSALWDWVVGWVDAAWSL

SEQ ID NO: 2091 - protein, 28 aa, Artificial Sequence
  Description of Artificial Sequence: Synthetic peptide
  N-term acetylated
  C-term amidated
DDPKLYDKDLGSALWDWVVGWVDAATSL

SEQ ID NO: 2092 - protein, 28 aa, Artificial Sequence
  Description of Artificial Sequence: Synthetic peptide
  N-term acetylated
DDPKLYDKDLGSALWDWVVGWVDAATSL

SEQ ID NO: 2093 - protein, 28 aa, Artificial Sequence
  Description of Artificial Sequence: Synthetic peptide
  N-term acetylated
  C-term amidated
DDPKLYDKDLGSALWDWVVGWLDAAWSL

SEQ ID NO: 2094 - protein, 28 aa, Artificial Sequence
  Description of Artificial Sequence: Synthetic peptide
  N-term acetylated
DDPKLYDKDLGSALWDWVVGWLDAAWSL

SEQ ID NO: 2095 - protein, 28 aa, Artificial Sequence
  Description of Artificial Sequence: Synthetic peptide
  N-term acetylated
  C-term amidated
DDPKLYDKDLGSALWDWVVGWLDAATSL

SEQ ID NO: 2096 - protein, 28 aa, Artificial Sequence
  Description of Artificial Sequence: Synthetic peptide
  N-term acetylated
DDPKLYDKDLGSALWDWVVGWLDAATSL

SEQ ID NO: 2097 - protein, 28 aa, Artificial Sequence
  Description of Artificial Sequence: Synthetic peptide
  N-term acetylated
  C-term amidated
DDPKLYDKDLGSALWDWVVGWMDAAWSL

SEQ ID NO: 2098 - protein, 28 aa, Artificial Sequence
  Description of Artificial Sequence: Synthetic peptide
  N-term acetylated
DDPKLYDKDLGSALWDWVVGWMDAAWSL

SEQ ID NO: 2099 - protein, 28 aa, Artificial Sequence
  Description of Artificial Sequence: Synthetic peptide
  N-term acetylated
  C-term amidated
DDPKLYDKDLGSALWDWVVGWMDAATSL

SEQ ID NO: 2100 - protein, 28 aa, Artificial Sequence
  Description of Artificial Sequence: Synthetic peptide
  N-term acetylated
DDPKLYDKDLGSALWDWVVGWMDAATSL

SEQ ID NO: 2101 - protein, 28 aa, Artificial Sequence
  Description of Artificial Sequence: Synthetic peptide
  N-term acetylated
  C-term amidated
DDPKLYDKDLGSALWDWVVGQVDAAWSL

SEQ ID NO: 2102 - protein, 28 aa, Artificial Sequence
  Description of Artificial Sequence: Synthetic peptide
  N-term acetylated
DDPKLYDKDLGSALWDWVVGQVDAAWSL

SEQ ID NO: 2103 - protein, 28 aa, Artificial Sequence
  Description of Artificial Sequence: Synthetic peptide
  N-term acetylated
  C-term amidated
DDPKLYDKDLGSALWDWVVGQVDAATSL

SEQ ID NO: 2104 - protein, 28 aa, Artificial Sequence
  Description of Artificial Sequence: Synthetic peptide
  N-term acetylated
DDPKLYDKDLGSALWDWVVGQVDAATSL

SEQ ID NO: 2105 - protein, 28 aa, Artificial Sequence
  Description of Artificial Sequence: Synthetic peptide
  N-term acetylated
  C-term amidated
DDPKLYDKDLGSALWDWVVGQLDAAWSL

SEQ ID NO: 2106 - protein, 28 aa, Artificial Sequence
  Description of Artificial Sequence: Synthetic peptide
  N-term acetylated
DDPKLYDKDLGSALWDWVVGQLDAAWSL

SEQ ID NO: 2107 - protein, 28 aa, Artificial Sequence
  Description of Artificial Sequence: Synthetic peptide
  N-term acetylated
  C-term amidated
DDPKLYDKDLGSALWDWVVGQLDAATSL

SEQ ID NO: 2108 - protein, 28 aa, Artificial Sequence
  Description of Artificial Sequence: Synthetic peptide
  N-term acetylated
DDPKLYDKDLGSALWDWVVGQLDAATSL

SEQ ID NO: 2109 - protein, 28 aa, Artificial Sequence
  Description of Artificial Sequence: Synthetic peptide
  N-term acetylated
  C-term amidated
DDPKLYDKDLGSALWDWVVGQMDAAWSL

SEQ ID NO: 2110 - protein, 28 aa, Artificial Sequence
  Description of Artificial Sequence: Synthetic peptide
  N-term acetylated
DDPKLYDKDLGSALWDWVVGQMDAAWSL

SEQ ID NO: 2111 - protein, 28 aa, Artificial Sequence
  Description of Artificial Sequence: Synthetic peptide
  N-term acetylated
  C-term amidated
DDPKLYDKDLGSALWDWVVGQMDAATSL

SEQ ID NO: 2112 - protein, 28 aa, Artificial Sequence
  Description of Artificial Sequence: Synthetic peptide
  N-term acetylated
DDPKLYDKDLGSALWDWVVGQMDAATSL

SEQ ID NO: 2113 - protein, 28 aa, Artificial Sequence
  Description of Artificial Sequence: Synthetic peptide
  N-term acetylated
  C-term amidated
DDPKLYDKDLGSALWDTVVAWVDAAWSL

SEQ ID NO: 2114 - protein, 28 aa, Artificial Sequence
  Description of Artificial Sequence: Synthetic peptide
  N-term acetylated
DDPKLYDKDLGSALWDTVVAWVDAAWSL

SEQ ID NO: 2115 - protein, 28 aa, Artificial Sequence
  Description of Artificial Sequence: Synthetic peptide
  N-term acetylated
  C-term amidated
DDPKLYDKDLGSALWDTVVAWVDAATSL

SEQ ID NO: 2116 - protein, 28 aa, Artificial Sequence
  Description of Artificial Sequence: Synthetic peptide
  N-term acetylated
DDPKLYDKDLGSALWDTVVAWVDAATSL

SEQ ID NO: 2117 - protein, 28 aa, Artificial Sequence
  Description of Artificial Sequence: Synthetic peptide
  N-term acetylated
  C-term amidated
DDPKLYDKDLGSALWDTVVAWLDAAWSL

SEQ ID NO: 2118 - protein, 28 aa, Artificial Sequence
  Description of Artificial Sequence: Synthetic peptide
  N-term acetylated
DDPKLYDKDLGSALWDTVVAWLDAAWSL

SEQ ID NO: 2119 - protein, 28 aa, Artificial Sequence
  Description of Artificial Sequence: Synthetic peptide
  N-term acetylated
  C-term amidated
DDPKLYDKDLGSALWDTVVAWLDAATSL

SEQ ID NO: 2120 - protein, 28 aa, Artificial Sequence
  Description of Artificial Sequence: Synthetic peptide
  N-term acetylated
DDPKLYDKDLGSALWDTVVAWLDAATSL

SEQ ID NO: 2121 - protein, 28 aa, Artificial Sequence
  Description of Artificial Sequence: Synthetic peptide
  N-term acetylated
  C-term amidated
DDPKLYDKDLGSALWDTVVAWMDAAWSL

SEQ ID NO: 2122 - protein, 28 aa, Artificial Sequence
  Description of Artificial Sequence: Synthetic peptide
  N-term acetylated
DDPKLYDKDLGSALWDTVVAWMDAAWSL

SEQ ID NO: 2123 - protein, 28 aa, Artificial Sequence
  Description of Artificial Sequence: Synthetic peptide
  N-term acetylated
  C-term amidated
DDPKLYDKDLGSALWDTVVAWMDAATSL

SEQ ID NO: 2124 - protein, 28 aa, Artificial Sequence
  Description of Artificial Sequence: Synthetic peptide
  N-term acetylated
DDPKLYDKDLGSALWDTVVAWMDAATSL

SEQ ID NO: 2125 - protein, 28 aa, Artificial Sequence
  Description of Artificial Sequence: Synthetic peptide
  N-term acetylated
  C-term amidated
DDPKLYDKDLGSALWDTVVAQVDAAWSL

SEQ ID NO: 2126 - protein, 28 aa, Artificial Sequence
  Description of Artificial Sequence: Synthetic peptide
  N-term acetylated
DDPKLYDKDLGSALWDTVVAQVDAAWSL

SEQ ID NO: 2127 - protein, 28 aa, Artificial Sequence
  Description of Artificial Sequence: Synthetic peptide
  N-term acetylated
  C-term amidated
DDPKLYDKDLGSALWDTVVAQVDAATSL

SEQ ID NO: 2128 - protein, 28 aa, Artificial Sequence
  Description of Artificial Sequence: Synthetic peptide
  N-term acetylated
DDPKLYDKDLGSALWDTVVAQVDAATSL

SEQ ID NO: 2129 - protein, 28 aa, Artificial Sequence
  Description of Artificial Sequence: Synthetic peptide
  N-term acetylated
  C-term amidated
DDPKLYDKDLGSALWDTVVAQLDAAWSL

SEQ ID NO: 2130 - protein, 28 aa, Artificial Sequence
  Description of Artificial Sequence: Synthetic peptide
  N-term acetylated
DDPKLYDKDLGSALWDTVVAQLDAAWSL

SEQ ID NO: 2131 - protein, 28 aa, Artificial Sequence
  Description of Artificial Sequence: Synthetic peptide
  N-term acetylated
  C-term amidated
DDPKLYDKDLGSALWDTVVAQLDAATSL

SEQ ID NO: 2132 - protein, 28 aa, Artificial Sequence
  Description of Artificial Sequence: Synthetic peptide
  N-term acetylated
DDPKLYDKDLGSALWDTVVAQLDAATSL

SEQ ID NO: 2133 - protein, 28 aa, Artificial Sequence
  Description of Artificial Sequence: Synthetic peptide
  N-term acetylated
  C-term amidated
DDPKLYDKDLGSALWDTVVAQMDAAWSL

SEQ ID NO: 2134 - protein, 28 aa, Artificial Sequence
  Description of Artificial Sequence: Synthetic peptide
  N-term acetylated
DDPKLYDKDLGSALWDTVVAQMDAAWSL

SEQ ID NO: 2135 - protein, 28 aa, Artificial Sequence
  Description of Artificial Sequence: Synthetic peptide
  N-term acetylated
  C-term amidated
DDPKLYDKDLGSALWDTVVAQMDAATSL

SEQ ID NO: 2136 - protein, 28 aa, Artificial Sequence
  Description of Artificial Sequence: Synthetic peptide
  N-term acetylated
DDPKLYDKDLGSALWDTVVAQMDAATSL

SEQ ID NO: 2137 - protein, 28 aa, Artificial Sequence
  Description of Artificial Sequence: Synthetic peptide
  N-term acetylated
  C-term amidated
DDPKLYDKDLGSALWDTVVGWVDAAWSL

SEQ ID NO: 2138 - protein, 28 aa, Artificial Sequence
  Description of Artificial Sequence: Synthetic peptide
  N-term acetylated
DDPKLYDKDLGSALWDTVVGWVDAAWSL

SEQ ID NO: 2139 - protein, 28 aa, Artificial Sequence
  Description of Artificial Sequence: Synthetic peptide
  N-term acetylated
  C-term amidated
DDPKLYDKDLGSALWDTVVGWVDAATSL

SEQ ID NO: 2140 - protein, 28 aa, Artificial Sequence
  Description of Artificial Sequence: Synthetic peptide
  N-term acetylated
DDPKLYDKDLGSALWDTVVGWVDAATSL

SEQ ID NO: 2141 - protein, 28 aa, Artificial Sequence
  Description of Artificial Sequence: Synthetic peptide
  N-term acetylated
  C-term amidated
DDPKLYDKDLGSALWDTVVGWLDAAWSL

SEQ ID NO: 2142 - protein, 28 aa, Artificial Sequence
  Description of Artificial Sequence: Synthetic peptide
  N-term acetylated
DDPKLYDKDLGSALWDTVVGWLDAAWSL

SEQ ID NO: 2143 - protein, 28 aa, Artificial Sequence
  Description of Artificial Sequence: Synthetic peptide
  N-term acetylated
  C-term amidated
DDPKLYDKDLGSALWDTVVGWLDAATSL

SEQ ID NO: 2144 - protein, 28 aa, Artificial Sequence
  Description of Artificial Sequence: Synthetic peptide
  N-term acetylated
DDPKLYDKDLGSALWDTVVGWLDAATSL

SEQ ID NO: 2145 - protein, 28 aa, Artificial Sequence
  Description of Artificial Sequence: Synthetic peptide
  N-term acetylated
  C-term amidated
DDPKLYDKDLGSALWDTVVGWMDAAWSL

SEQ ID NO: 2146 - protein, 28 aa, Artificial Sequence
  Description of Artificial Sequence: Synthetic peptide
  N-term acetylated
DDPKLYDKDLGSALWDTVVGWMDAAWSL

SEQ ID NO: 2147 - protein, 28 aa, Artificial Sequence
  Description of Artificial Sequence: Synthetic peptide
  N-term acetylated
  C-term amidated
DDPKLYDKDLGSALWDTVVGWMDAATSL

SEQ ID NO: 2148 - protein, 28 aa, Artificial Sequence
  Description of Artificial Sequence: Synthetic peptide
  N-term acetylated
DDPKLYDKDLGSALWDTVVGWMDAATSL

SEQ ID NO: 2149 - protein, 28 aa, Artificial Sequence
  Description of Artificial Sequence: Synthetic peptide
  N-term acetylated
  C-term amidated
DDPKLYDKDLGSALWDTVVGQVDAAWSL

SEQ ID NO: 2150 - protein, 28 aa, Artificial Sequence
  Description of Artificial Sequence: Synthetic peptide
  N-term acetylated
DDPKLYDKDLGSALWDTVVGQVDAAWSL

SEQ ID NO: 2151 - protein, 28 aa, Artificial Sequence
  Description of Artificial Sequence: Synthetic peptide
  N-term acetylated
  C-term amidated
DDPKLYDKDLGSALWDTVVGQVDAATSL

SEQ ID NO: 2152 - protein, 28 aa, Artificial Sequence
  Description of Artificial Sequence: Synthetic peptide
  N-term acetylated
DDPKLYDKDLGSALWDTVVGQVDAATSL

SEQ ID NO: 2153 - protein, 28 aa, Artificial Sequence
  Description of Artificial Sequence: Synthetic peptide
  N-term acetylated
  C-term amidated
DDPKLYDKDLGSALWDTVVGQLDAAWSL

SEQ ID NO: 2154 - protein, 28 aa, Artificial Sequence
  Description of Artificial Sequence: Synthetic peptide
  N-term acetylated
DDPKLYDKDLGSALWDTVVGQLDAAWSL

SEQ ID NO: 2155 - protein, 28 aa, Artificial Sequence
  Description of Artificial Sequence: Synthetic peptide
  N-term acetylated
  C-term amidated
DDPKLYDKDLGSALWDTVVGQLDAATSL

SEQ ID NO: 2156 - protein, 28 aa, Artificial Sequence
  Description of Artificial Sequence: Synthetic peptide
  N-term acetylated
DDPKLYDKDLGSALWDTVVGQLDAATSL

SEQ ID NO: 2157 - protein, 28 aa, Artificial Sequence
  Description of Artificial Sequence: Synthetic peptide
  N-term acetylated
  C-term amidated
DDPKLYDKDLGSALWDTVVGQMDAAWSL

SEQ ID NO: 2158 - protein, 28 aa, Artificial Sequence
  Description of Artificial Sequence: Synthetic peptide
  N-term acetylated
DDPKLYDKDLGSALWDTVVGQMDAAWSL

SEQ ID NO: 2159 - protein, 28 aa, Artificial Sequence
  Description of Artificial Sequence: Synthetic peptide
  N-term acetylated
  C-term amidated
DDPKLYDKDLGSALWDTVVGQMDAATSL

SEQ ID NO: 2160 - protein, 28 aa, Artificial Sequence
  Description of Artificial Sequence: Synthetic peptide
  N-term acetylated
DDPKLYDKDLGSALWDTVVGQMDAATSL

SEQ ID NO: 2161 - protein, 28 aa, Artificial Sequence
  Description of Artificial Sequence: Synthetic peptide
  N-term acetylated
  C-term amidated
DDPKLYDKDLGSALTDWVVAWVDAAWSL

SEQ ID NO: 2162 - protein, 28 aa, Artificial Sequence
  Description of Artificial Sequence: Synthetic peptide
  N-term acetylated
DDPKLYDKDLGSALTDWVVAWVDAAWSL

SEQ ID NO: 2163 - protein, 28 aa, Artificial Sequence
  Description of Artificial Sequence: Synthetic peptide
  N-term acetylated
  C-term amidated
DDPKLYDKDLGSALTDWVVAWVDAATSL

SEQ ID NO: 2164 - protein, 28 aa, Artificial Sequence
  Description of Artificial Sequence: Synthetic peptide
  N-term acetylated
DDPKLYDKDLGSALTDWVVAWVDAATSL

SEQ ID NO: 2165 - protein, 28 aa, Artificial Sequence
  Description of Artificial Sequence: Synthetic peptide
  N-term acetylated
  C-term amidated
DDPKLYDKDLGSALTDWVVAWLDAAWSL

SEQ ID NO: 2166 - protein, 28 aa, Artificial Sequence
  Description of Artificial Sequence: Synthetic peptide
  N-term acetylated
DDPKLYDKDLGSALTDWVVAWLDAAWSL

SEQ ID NO: 2167 - protein, 28 aa, Artificial Sequence
  Description of Artificial Sequence: Synthetic peptide
  N-term acetylated
  C-term amidated
DDPKLYDKDLGSALTDWVVAWLDAATSL

SEQ ID NO: 2168 - protein, 28 aa, Artificial Sequence
  Description of Artificial Sequence: Synthetic peptide
  N-term acetylated
DDPKLYDKDLGSALTDWVVAWLDAATSL

SEQ ID NO: 2169 - protein, 28 aa, Artificial Sequence
  Description of Artificial Sequence: Synthetic peptide
  N-term acetylated
  C-term amidated
DDPKLYDKDLGSALTDWVVAWMDAAWSL

SEQ ID NO: 2170 - protein, 28 aa, Artificial Sequence
  Description of Artificial Sequence: Synthetic peptide
  N-term acetylated
DDPKLYDKDLGSALTDWVVAWMDAAWSL

SEQ ID NO: 2171 - protein, 28 aa, Artificial Sequence
  Description of Artificial Sequence: Synthetic peptide
  N-term acetylated
  C-term amidated
DDPKLYDKDLGSALTDWVVAWMDAATSL

SEQ ID NO: 2172 - protein, 28 aa, Artificial Sequence
  Description of Artificial Sequence: Synthetic peptide
  N-term acetylated
DDPKLYDKDLGSALTDWVVAWMDAATSL

SEQ ID NO: 2173 - protein, 28 aa, Artificial Sequence
  Description of Artificial Sequence: Synthetic peptide
  N-term acetylated
  C-term amidated
DDPKLYDKDLGSALTDWVVAQVDAAWSL

SEQ ID NO: 2174 - protein, 28 aa, Artificial Sequence
  Description of Artificial Sequence: Synthetic peptide
  N-term acetylated
DDPKLYDKDLGSALTDWVVAQVDAAWSL

SEQ ID NO: 2175 - protein, 28 aa, Artificial Sequence
  Description of Artificial Sequence: Synthetic peptide
  N-term acetylated
  C-term amidated
DDPKLYDKDLGSALTDWVVAQVDAATSL

SEQ ID NO: 2176 - protein, 28 aa, Artificial Sequence
  Description of Artificial Sequence: Synthetic peptide
  N-term acetylated
DDPKLYDKDLGSALTDWVVAQVDAATSL

SEQ ID NO: 2177 - protein, 28 aa, Artificial Sequence
  Description of Artificial Sequence: Synthetic peptide
  N-term acetylated
  C-term amidated
DDPKLYDKDLGSALTDWVVAQLDAAWSL

SEQ ID NO: 2178 - protein, 28 aa, Artificial Sequence
  Description of Artificial Sequence: Synthetic peptide
  N-term acetylated
DDPKLYDKDLGSALTDWVVAQLDAAWSL

SEQ ID NO: 2179 - protein, 28 aa, Artificial Sequence
  Description of Artificial Sequence: Synthetic peptide
  N-term acetylated
  C-term amidated
DDPKLYDKDLGSALTDWVVAQLDAATSL

SEQ ID NO: 2180 - protein, 28 aa, Artificial Sequence
  Description of Artificial Sequence: Synthetic peptide
  N-term acetylated
DDPKLYDKDLGSALTDWVVAQLDAATSL

SEQ ID NO: 2181 - protein, 28 aa, Artificial Sequence
  Description of Artificial Sequence: Synthetic peptide
  N-term acetylated
  C-term amidated
DDPKLYDKDLGSALTDWVVAQMDAAWSL

SEQ ID NO: 2182 - protein, 28 aa, Artificial Sequence
  Description of Artificial Sequence: Synthetic peptide
  N-term acetylated
DDPKLYDKDLGSALTDWVVAQMDAAWSL

SEQ ID NO: 2183 - protein, 28 aa, Artificial Sequence
  Description of Artificial Sequence: Synthetic peptide
  N-term acetylated
  C-term amidated
DDPKLYDKDLGSALTDWVVAQMDAATSL

SEQ ID NO: 2184 - protein, 28 aa, Artificial Sequence
  Description of Artificial Sequence: Synthetic peptide
  N-term acetylated
DDPKLYDKDLGSALTDWVVAQMDAATSL

SEQ ID NO: 2185 - protein, 28 aa, Artificial Sequence
  Description of Artificial Sequence: Synthetic peptide
  N-term acetylated
  C-term amidated
DDPKLYDKDLGSALTDWVVGWVDAAWSL

SEQ ID NO: 2186 - protein, 28 aa, Artificial Sequence
  Description of Artificial Sequence: Synthetic peptide
  N-term acetylated
DDPKLYDKDLGSALTDWVVGWVDAAWSL

SEQ ID NO: 2187 - protein, 28 aa, Artificial Sequence
  Description of Artificial Sequence: Synthetic peptide
  N-term acetylated
  C-term amidated
DDPKLYDKDLGSALTDWVVGWVDAATSL

SEQ ID NO: 2188 - protein, 28 aa, Artificial Sequence
  Description of Artificial Sequence: Synthetic peptide
  N-term acetylated
DDPKLYDKDLGSALTDWVVGWVDAATSL

SEQ ID NO: 2189 - protein, 28 aa, Artificial Sequence
  Description of Artificial Sequence: Synthetic peptide
  N-term acetylated
  C-term amidated
DDPKLYDKDLGSALTDWVVGWLDAAWSL

SEQ ID NO: 2190 - protein, 28 aa, Artificial Sequence
  Description of Artificial Sequence: Synthetic peptide
  N-term acetylated
DDPKLYDKDLGSALTDWVVGWLDAAWSL

SEQ ID NO: 2191 - protein, 28 aa, Artificial Sequence
  Description of Artificial Sequence: Synthetic peptide
  N-term acetylated
  C-term amidated
DDPKLYDKDLGSALTDWVVGWLDAATSL

SEQ ID NO: 2192 - protein, 28 aa, Artificial Sequence
  Description of Artificial Sequence: Synthetic peptide
  N-term acetylated
DDPKLYDKDLGSALTDWVVGWLDAATSL

SEQ ID NO: 2193 - protein, 28 aa, Artificial Sequence
  Description of Artificial Sequence: Synthetic peptide
  N-term acetylated
  C-term amidated
DDPKLYDKDLGSALTDWVVGWMDAAWSL

SEQ ID NO: 2194 - protein, 28 aa, Artificial Sequence
  Description of Artificial Sequence: Synthetic peptide
  N-term acetylated
DDPKLYDKDLGSALTDWVVGWMDAAWSL

SEQ ID NO: 2195 - protein, 28 aa, Artificial Sequence
  Description of Artificial Sequence: Synthetic peptide
  N-term acetylated
  C-term amidated
DDPKLYDKDLGSALTDWVVGWMDAATSL

SEQ ID NO: 2196 - protein, 28 aa, Artificial Sequence
  Description of Artificial Sequence: Synthetic peptide
  N-term acetylated
DDPKLYDKDLGSALTDWVVGWMDAATSL

SEQ ID NO: 2197 - protein, 28 aa, Artificial Sequence
  Description of Artificial Sequence: Synthetic peptide
  N-term acetylated
  C-term amidated
DDPKLYDKDLGSALTDWVVGQVDAAWSL

SEQ ID NO: 2198 - protein, 28 aa, Artificial Sequence
  Description of Artificial Sequence: Synthetic peptide
  N-term acetylated
DDPKLYDKDLGSALTDWVVGQVDAAWSL

SEQ ID NO: 2199 - protein, 28 aa, Artificial Sequence
  Description of Artificial Sequence: Synthetic peptide
  N-term acetylated
  C-term amidated
DDPKLYDKDLGSALTDWVVGQVDAATSL

SEQ ID NO: 2200 - protein, 28 aa, Artificial Sequence
  Description of Artificial Sequence: Synthetic peptide
  N-term acetylated
DDPKLYDKDLGSALTDWVVGQVDAATSL

SEQ ID NO: 2201 - protein, 28 aa, Artificial Sequence
  Description of Artificial Sequence: Synthetic peptide
  N-term acetylated
  C-term amidated
DDPKLYDKDLGSALTDWVVGQLDAAWSL

SEQ ID NO: 2202 - protein, 28 aa, Artificial Sequence
  Description of Artificial Sequence: Synthetic peptide
  N-term acetylated
DDPKLYDKDLGSALTDWVVGQLDAAWSL

SEQ ID NO: 2203 - protein, 28 aa, Artificial Sequence
  Description of Artificial Sequence: Synthetic peptide
  N-term acetylated
  C-term amidated
DDPKLYDKDLGSALTDWVVGQLDAATSL

SEQ ID NO: 2204 - protein, 28 aa, Artificial Sequence
  Description of Artificial Sequence: Synthetic peptide
  N-term acetylated
DDPKLYDKDLGSALTDWVVGQLDAATSL

SEQ ID NO: 2205 - protein, 28 aa, Artificial Sequence
  Description of Artificial Sequence: Synthetic peptide
  N-term acetylated
  C-term amidated
DDPKLYDKDLGSALTDWVVGQMDAAWSL

SEQ ID NO: 2206 - protein, 28 aa, Artificial Sequence
  Description of Artificial Sequence: Synthetic peptide
  N-term acetylated
DDPKLYDKDLGSALTDWVVGQMDAAWSL

SEQ ID NO: 2207 - protein, 28 aa, Artificial Sequence
  Description of Artificial Sequence: Synthetic peptide
  N-term acetylated
  C-term amidated
DDPKLYDKDLGSALTDWVVGQMDAATSL

SEQ ID NO: 2208 - protein, 28 aa, Artificial Sequence
  Description of Artificial Sequence: Synthetic peptide
  N-term acetylated
DDPKLYDKDLGSALTDWVVGQMDAATSL

SEQ ID NO: 2209 - protein, 28 aa, Artificial Sequence
  Description of Artificial Sequence: Synthetic peptide
  N-term acetylated
  C-term amidated
DDPKLYDKDLGSALTDTVVAWVDAAWSL

SEQ ID NO: 2210 - protein, 28 aa, Artificial Sequence
  Description of Artificial Sequence: Synthetic peptide
  N-term acetylated
DDPKLYDKDLGSALTDTVVAWVDAAWSL

SEQ ID NO: 2211 - protein, 28 aa, Artificial Sequence
  Description of Artificial Sequence: Synthetic peptide
  N-term acetylated
  C-term amidated
DDPKLYDKDLGSALTDTVVAWVDAATSL

SEQ ID NO: 2212 - protein, 28 aa, Artificial Sequence
  Description of Artificial Sequence: Synthetic peptide
  N-term acetylated
DDPKLYDKDLGSALTDTVVAWVDAATSL

SEQ ID NO: 2213 - protein, 28 aa, Artificial Sequence
  Description of Artificial Sequence: Synthetic peptide
  N-term acetylated
  C-term amidated
DDPKLYDKDLGSALTDTVVAWLDAAWSL

SEQ ID NO: 2214 - protein, 28 aa, Artificial Sequence
  Description of Artificial Sequence: Synthetic peptide
  N-term acetylated
DDPKLYDKDLGSALTDTVVAWLDAAWSL

SEQ ID NO: 2215 - protein, 28 aa, Artificial Sequence
  Description of Artificial Sequence: Synthetic peptide
  N-term acetylated
  C-term amidated
DDPKLYDKDLGSALTDTVVAWLDAATSL

SEQ ID NO: 2216 - protein, 28 aa, Artificial Sequence
  Description of Artificial Sequence: Synthetic peptide
  N-term acetylated
DDPKLYDKDLGSALTDTVVAWLDAATSL

SEQ ID NO: 2217 - protein, 28 aa, Artificial Sequence
  Description of Artificial Sequence: Synthetic peptide
  N-term acetylated
  C-term amidated
DDPKLYDKDLGSALTDTVVAWMDAAWSL

SEQ ID NO: 2218 - protein, 28 aa, Artificial Sequence
  Description of Artificial Sequence: Synthetic peptide
  N-term acetylated
DDPKLYDKDLGSALTDTVVAWMDAAWSL

SEQ ID NO: 2219 - protein, 28 aa, Artificial Sequence
  Description of Artificial Sequence: Synthetic peptide
  N-term acetylated
  C-term amidated
DDPKLYDKDLGSALTDTVVAWMDAATSL

SEQ ID NO: 2220 - protein, 28 aa, Artificial Sequence
  Description of Artificial Sequence: Synthetic peptide
  N-term acetylated
DDPKLYDKDLGSALTDTVVAWMDAATSL

SEQ ID NO: 2221 - protein, 28 aa, Artificial Sequence
  Description of Artificial Sequence: Synthetic peptide
  N-term acetylated
  C-term amidated
DDPKLYDKDLGSALTDTVVAQVDAAWSL

SEQ ID NO: 2222 - protein, 28 aa, Artificial Sequence
  Description of Artificial Sequence: Synthetic peptide
  N-term acetylated
DDPKLYDKDLGSALTDTVVAQVDAAWSL

SEQ ID NO: 2223 - protein, 28 aa, Artificial Sequence
  Description of Artificial Sequence: Synthetic peptide
  N-term acetylated
  C-term amidated
DDPKLYDKDLGSALTDTVVAQVDAATSL

SEQ ID NO: 2224 - protein, 28 aa, Artificial Sequence
  Description of Artificial Sequence: Synthetic peptide
  N-term acetylated
DDPKLYDKDLGSALTDTVVAQVDAATSL

SEQ ID NO: 2225 - protein, 28 aa, Artificial Sequence
  Description of Artificial Sequence: Synthetic peptide
  N-term acetylated
  C-term amidated
DDPKLYDKDLGSALTDTVVAQLDAAWSL

SEQ ID NO: 2226 - protein, 28 aa, Artificial Sequence
  Description of Artificial Sequence: Synthetic peptide
  N-term acetylated
DDPKLYDKDLGSALTDTVVAQLDAAWSL

SEQ ID NO: 2227 - protein, 28 aa, Artificial Sequence
  Description of Artificial Sequence: Synthetic peptide
  N-term acetylated
  C-term amidated
DDPKLYDKDLGSALTDTVVAQLDAATSL

SEQ ID NO: 2228 - protein, 28 aa, Artificial Sequence
  Description of Artificial Sequence: Synthetic peptide
  N-term acetylated
DDPKLYDKDLGSALTDTVVAQLDAATSL

SEQ ID NO: 2229 - protein, 28 aa, Artificial Sequence
  Description of Artificial Sequence: Synthetic peptide
  N-term acetylated
  C-term amidated
DDPKLYDKDLGSALTDTVVAQMDAAWSL

SEQ ID NO: 2230 - protein, 28 aa, Artificial Sequence
  Description of Artificial Sequence: Synthetic peptide
  N-term acetylated
DDPKLYDKDLGSALTDTVVAQMDAAWSL

SEQ ID NO: 2231 - protein, 28 aa, Artificial Sequence
  Description of Artificial Sequence: Synthetic peptide
  N-term acetylated
  C-term amidated
DDPKLYDKDLGSALTDTVVAQMDAATSL

SEQ ID NO: 2232 - protein, 28 aa, Artificial Sequence
  Description of Artificial Sequence: Synthetic peptide
  N-term acetylated
DDPKLYDKDLGSALTDTVVAQMDAATSL

SEQ ID NO: 2233 - protein, 28 aa, Artificial Sequence
  Description of Artificial Sequence: Synthetic peptide
  N-term acetylated
  C-term amidated
DDPKLYDKDLGSALTDTVVGWVDAAWSL

SEQ ID NO: 2234 - protein, 28 aa, Artificial Sequence
  Description of Artificial Sequence: Synthetic peptide
  N-term acetylated
DDPKLYDKDLGSALTDTVVGWVDAAWSL

SEQ ID NO: 2235 - protein, 28 aa, Artificial Sequence
  Description of Artificial Sequence: Synthetic peptide
  N-term acetylated
  C-term amidated
DDPKLYDKDLGSALTDTVVGWVDAATSL

SEQ ID NO: 2236 - protein, 28 aa, Artificial Sequence
  Description of Artificial Sequence: Synthetic peptide
  N-term acetylated
DDPKLYDKDLGSALTDTVVGWVDAATSL

SEQ ID NO: 2237 - protein, 28 aa, Artificial Sequence
  Description of Artificial Sequence: Synthetic peptide
  N-term acetylated
  C-term amidated
DDPKLYDKDLGSALTDTVVGWLDAAWSL

SEQ ID NO: 2238 - protein, 28 aa, Artificial Sequence
  Description of Artificial Sequence: Synthetic peptide
  N-term acetylated
DDPKLYDKDLGSALTDTVVGWLDAAWSL

SEQ ID NO: 2239 - protein, 28 aa, Artificial Sequence
  Description of Artificial Sequence: Synthetic peptide
  N-term acetylated
  C-term amidated
DDPKLYDKDLGSALTDTVVGWLDAATSL

SEQ ID NO: 2240 - protein, 28 aa, Artificial Sequence
  Description of Artificial Sequence: Synthetic peptide
  N-term acetylated
DDPKLYDKDLGSALTDTVVGWLDAATSL

SEQ ID NO: 2241 - protein, 28 aa, Artificial Sequence
  Description of Artificial Sequence: Synthetic peptide
  N-term acetylated
  C-term amidated
DDPKLYDKDLGSALTDTVVGWMDAAWSL

SEQ ID NO: 2242 - protein, 28 aa, Artificial Sequence
  Description of Artificial Sequence: Synthetic peptide
  N-term acetylated
DDPKLYDKDLGSALTDTVVGWMDAAWSL

SEQ ID NO: 2243 - protein, 28 aa, Artificial Sequence
  Description of Artificial Sequence: Synthetic peptide
  N-term acetylated
  C-term amidated
DDPKLYDKDLGSALTDTVVGWMDAATSL

SEQ ID NO: 2244 - protein, 28 aa, Artificial Sequence
  Description of Artificial Sequence: Synthetic peptide
  N-term acetylated
DDPKLYDKDLGSALTDTVVGWMDAATSL

SEQ ID NO: 2245 - protein, 28 aa, Artificial Sequence
  Description of Artificial Sequence: Synthetic peptide
  N-term acetylated
  C-term amidated
DDPKLYDKDLGSALTDTVVGQVDAAWSL

SEQ ID NO: 2246 - protein, 28 aa, Artificial Sequence
  Description of Artificial Sequence: Synthetic peptide
  N-term acetylated
DDPKLYDKDLGSALTDTVVGQVDAAWSL

SEQ ID NO: 2247 - protein, 28 aa, Artificial Sequence
  Description of Artificial Sequence: Synthetic peptide
  N-term acetylated
  C-term amidated
DDPKLYDKDLGSALTDTVVGQVDAATSL

SEQ ID NO: 2248 - protein, 28 aa, Artificial Sequence
  Description of Artificial Sequence: Synthetic peptide
  N-term acetylated
DDPKLYDKDLGSALTDTVVGQVDAATSL

SEQ ID NO: 2249 - protein, 28 aa, Artificial Sequence
  Description of Artificial Sequence: Synthetic peptide
  N-term acetylated
  C-term amidated
DDPKLYDKDLGSALTDTVVGQLDAAWSL

SEQ ID NO: 2250 - protein, 28 aa, Artificial Sequence
  Description of Artificial Sequence: Synthetic peptide
  N-term acetylated
DDPKLYDKDLGSALTDTVVGQLDAAWSL

SEQ ID NO: 2251 - protein, 28 aa, Artificial Sequence
  Description of Artificial Sequence: Synthetic peptide
  N-term acetylated
  C-term amidated
DDPKLYDKDLGSALTDTVVGQLDAATSL

SEQ ID NO: 2252 - protein, 28 aa, Artificial Sequence
  Description of Artificial Sequence: Synthetic peptide
  N-term acetylated
DDPKLYDKDLGSALTDTVVGQLDAATSL

SEQ ID NO: 2253 - protein, 28 aa, Artificial Sequence
  Description of Artificial Sequence: Synthetic peptide
  N-term acetylated
  C-term amidated
DDPKLYDKDLGSALTDTVVGQMDAAWSL

SEQ ID NO: 2254 - protein, 28 aa, Artificial Sequence
  Description of Artificial Sequence: Synthetic peptide
  N-term acetylated
DDPKLYDKDLGSALTDTVVGQMDAAWSL

SEQ ID NO: 2255 - protein, 28 aa, Artificial Sequence
  Description of Artificial Sequence: Synthetic peptide
  N-term acetylated
  C-term amidated
DDPKLYDKDLGSALTDTVVGQMDAATSL

SEQ ID NO: 2256 - protein, 28 aa, Artificial Sequence
  Description of Artificial Sequence: Synthetic peptide
  N-term acetylated
DDPKLYDKDLGSALTDTVVGQMDAATSL

SEQ ID NO: 2257 - protein, 28 aa, Artificial Sequence
  Description of Artificial Sequence: Synthetic peptide
  N-term acetylated
  C-term amidated
DDPKLYDKDLGSALGDWVVAWVDAAWSL

SEQ ID NO: 2258 - protein, 28 aa, Artificial Sequence
  Description of Artificial Sequence: Synthetic peptide
  N-term acetylated
DDPKLYDKDLGSALGDWVVAWVDAAWSL

SEQ ID NO: 2259 - protein, 28 aa, Artificial Sequence
  Description of Artificial Sequence: Synthetic peptide
  N-term acetylated
  C-term amidated
DDPKLYDKDLGSALGDWVVAWVDAATSL

SEQ ID NO: 2260 - protein, 28 aa, Artificial Sequence
  Description of Artificial Sequence: Synthetic peptide
  N-term acetylated
DDPKLYDKDLGSALGDWVVAWVDAATSL

SEQ ID NO: 2261 - protein, 28 aa, Artificial Sequence
  Description of Artificial Sequence: Synthetic peptide
  N-term acetylated
  C-term amidated
DDPKLYDKDLGSALGDWVVAWLDAAWSL

SEQ ID NO: 2262 - protein, 28 aa, Artificial Sequence
  Description of Artificial Sequence: Synthetic peptide
  N-term acetylated
DDPKLYDKDLGSALGDWVVAWLDAAWSL

SEQ ID NO: 2263 - protein, 28 aa, Artificial Sequence
  Description of Artificial Sequence: Synthetic peptide
  N-term acetylated
  C-term amidated
DDPKLYDKDLGSALGDWVVAWLDAATSL

SEQ ID NO: 2264 - protein, 28 aa, Artificial Sequence
  Description of Artificial Sequence: Synthetic peptide
  N-term acetylated
DDPKLYDKDLGSALGDWVVAWLDAATSL

SEQ ID NO: 2265 - protein, 28 aa, Artificial Sequence
  Description of Artificial Sequence: Synthetic peptide
  N-term acetylated
  C-term amidated
DDPKLYDKDLGSALGDWVVAWMDAAWSL

SEQ ID NO: 2266 - protein, 28 aa, Artificial Sequence
  Description of Artificial Sequence: Synthetic peptide
  N-term acetylated
DDPKLYDKDLGSALGDWVVAWMDAAWSL

SEQ ID NO: 2267 - protein, 28 aa, Artificial Sequence
  Description of Artificial Sequence: Synthetic peptide
  N-term acetylated
  C-term amidated
DDPKLYDKDLGSALGDWVVAWMDAATSL

SEQ ID NO: 2268 - protein, 28 aa, Artificial Sequence
  Description of Artificial Sequence: Synthetic peptide
  N-term acetylated
DDPKLYDKDLGSALGDWVVAWMDAATSL

SEQ ID NO: 2269 - protein, 28 aa, Artificial Sequence
  Description of Artificial Sequence: Synthetic peptide
  N-term acetylated
  C-term amidated
DDPKLYDKDLGSALGDWVVAQVDAAWSL

SEQ ID NO: 2270 - protein, 28 aa, Artificial Sequence
  Description of Artificial Sequence: Synthetic peptide
  N-term acetylated
DDPKLYDKDLGSALGDWVVAQVDAAWSL

SEQ ID NO: 2271 - protein, 28 aa, Artificial Sequence
  Description of Artificial Sequence: Synthetic peptide
  N-term acetylated
  C-term amidated
DDPKLYDKDLGSALGDWVVAQVDAATSL

SEQ ID NO: 2272 - protein, 28 aa, Artificial Sequence
  Description of Artificial Sequence: Synthetic peptide
  N-term acetylated
DDPKLYDKDLGSALGDWVVAQVDAATSL

SEQ ID NO: 2273 - protein, 28 aa, Artificial Sequence
  Description of Artificial Sequence: Synthetic peptide
  N-term acetylated
  C-term amidated
DDPKLYDKDLGSALGDWVVAQLDAAWSL

SEQ ID NO: 2274 - protein, 28 aa, Artificial Sequence
  Description of Artificial Sequence: Synthetic peptide
  N-term acetylated
DDPKLYDKDLGSALGDWVVAQLDAAWSL

SEQ ID NO: 2275 - protein, 28 aa, Artificial Sequence
  Description of Artificial Sequence: Synthetic peptide
  N-term acetylated
  C-term amidated
DDPKLYDKDLGSALGDWVVAQLDAATSL

SEQ ID NO: 2276 - protein, 28 aa, Artificial Sequence
  Description of Artificial Sequence: Synthetic peptide
  N-term acetylated
DDPKLYDKDLGSALGDWVVAQLDAATSL

SEQ ID NO: 2277 - protein, 28 aa, Artificial Sequence
  Description of Artificial Sequence: Synthetic peptide
  N-term acetylated
  C-term amidated
DDPKLYDKDLGSALGDWVVAQMDAAWSL

SEQ ID NO: 2278 - protein, 28 aa, Artificial Sequence
  Description of Artificial Sequence: Synthetic peptide
  N-term acetylated
DDPKLYDKDLGSALGDWVVAQMDAAWSL

SEQ ID NO: 2279 - protein, 28 aa, Artificial Sequence
  Description of Artificial Sequence: Synthetic peptide
  N-term acetylated
  C-term amidated
DDPKLYDKDLGSALGDWVVAQMDAATSL

SEQ ID NO: 2280 - protein, 28 aa, Artificial Sequence
  Description of Artificial Sequence: Synthetic peptide
  N-term acetylated
DDPKLYDKDLGSALGDWVVAQMDAATSL

SEQ ID NO: 2281 - protein, 28 aa, Artificial Sequence
  Description of Artificial Sequence: Synthetic peptide
  N-term acetylated
  C-term amidated
DDPKLYDKDLGSALGDWVVGWVDAAWSL

SEQ ID NO: 2282 - protein, 28 aa, Artificial Sequence
  Description of Artificial Sequence: Synthetic peptide
  N-term acetylated
DDPKLYDKDLGSALGDWVVGWVDAAWSL

SEQ ID NO: 2283 - protein, 28 aa, Artificial Sequence
  Description of Artificial Sequence: Synthetic peptide
  N-term acetylated
  C-term amidated
DDPKLYDKDLGSALGDWVVGWVDAATSL

SEQ ID NO: 2284 - protein, 28 aa, Artificial Sequence
  Description of Artificial Sequence: Synthetic peptide
  N-term acetylated
DDPKLYDKDLGSALGDWVVGWVDAATSL

SEQ ID NO: 2285 - protein, 28 aa, Artificial Sequence
  Description of Artificial Sequence: Synthetic peptide
  N-term acetylated
  C-term amidated
DDPKLYDKDLGSALGDWVVGWLDAAWSL

SEQ ID NO: 2286 - protein, 28 aa, Artificial Sequence
  Description of Artificial Sequence: Synthetic peptide
  N-term acetylated
DDPKLYDKDLGSALGDWVVGWLDAAWSL

SEQ ID NO: 2287 - protein, 28 aa, Artificial Sequence
  Description of Artificial Sequence: Synthetic peptide
  N-term acetylated
  C-term amidated
DDPKLYDKDLGSALGDWVVGWLDAATSL

SEQ ID NO: 2288 - protein, 28 aa, Artificial Sequence
  Description of Artificial Sequence: Synthetic peptide
  N-term acetylated
DDPKLYDKDLGSALGDWVVGWLDAATSL

SEQ ID NO: 2289 - protein, 28 aa, Artificial Sequence
  Description of Artificial Sequence: Synthetic peptide
  N-term acetylated
  C-term amidated
DDPKLYDKDLGSALGDWVVGWMDAAWSL

SEQ ID NO: 2290 - protein, 28 aa, Artificial Sequence
  Description of Artificial Sequence: Synthetic peptide
  N-term acetylated
DDPKLYDKDLGSALGDWVVGWMDAAWSL

SEQ ID NO: 2291 - protein, 28 aa, Artificial Sequence
  Description of Artificial Sequence: Synthetic peptide
  N-term acetylated
  C-term amidated
DDPKLYDKDLGSALGDWVVGWMDAATSL

SEQ ID NO: 2292 - protein, 28 aa, Artificial Sequence
  Description of Artificial Sequence: Synthetic peptide
  N-term acetylated
DDPKLYDKDLGSALGDWVVGWMDAATSL

SEQ ID NO: 2293 - protein, 28 aa, Artificial Sequence
  Description of Artificial Sequence: Synthetic peptide
  N-term acetylated
  C-term amidated
DDPKLYDKDLGSALGDWVVGQVDAAWSL

SEQ ID NO: 2294 - protein, 28 aa, Artificial Sequence
  Description of Artificial Sequence: Synthetic peptide
  N-term acetylated
DDPKLYDKDLGSALGDWVVGQVDAAWSL

SEQ ID NO: 2295 - protein, 28 aa, Artificial Sequence
  Description of Artificial Sequence: Synthetic peptide
  N-term acetylated
  C-term amidated
DDPKLYDKDLGSALGDWVVGQVDAATSL

SEQ ID NO: 2296 - protein, 28 aa, Artificial Sequence
  Description of Artificial Sequence: Synthetic peptide
  N-term acetylated
DDPKLYDKDLGSALGDWVVGQVDAATSL

SEQ ID NO: 2297 - protein, 28 aa, Artificial Sequence
  Description of Artificial Sequence: Synthetic peptide
  N-term acetylated
  C-term amidated
DDPKLYDKDLGSALGDWVVGQLDAAWSL

SEQ ID NO: 2298 - protein, 28 aa, Artificial Sequence
  Description of Artificial Sequence: Synthetic peptide
  N-term acetylated
DDPKLYDKDLGSALGDWVVGQLDAAWSL

SEQ ID NO: 2299 - protein, 28 aa, Artificial Sequence
  Description of Artificial Sequence: Synthetic peptide
  N-term acetylated
  C-term amidated
DDPKLYDKDLGSALGDWVVGQLDAATSL

SEQ ID NO: 2300 - protein, 28 aa, Artificial Sequence
  Description of Artificial Sequence: Synthetic peptide
  N-term acetylated
DDPKLYDKDLGSALGDWVVGQLDAATSL

SEQ ID NO: 2301 - protein, 28 aa, Artificial Sequence
  Description of Artificial Sequence: Synthetic peptide
  N-term acetylated
  C-term amidated
DDPKLYDKDLGSALGDWVVGQMDAAWSL

SEQ ID NO: 2302 - protein, 28 aa, Artificial Sequence
  Description of Artificial Sequence: Synthetic peptide
  N-term acetylated
DDPKLYDKDLGSALGDWVVGQMDAAWSL

SEQ ID NO: 2303 - protein, 28 aa, Artificial Sequence
  Description of Artificial Sequence: Synthetic peptide
  N-term acetylated
  C-term amidated
DDPKLYDKDLGSALGDWVVGQMDAATSL

SEQ ID NO: 2304 - protein, 28 aa, Artificial Sequence
  Description of Artificial Sequence: Synthetic peptide
  N-term acetylated
DDPKLYDKDLGSALGDWVVGQMDAATSL

SEQ ID NO: 2305 - protein, 28 aa, Artificial Sequence
  Description of Artificial Sequence: Synthetic peptide
  N-term acetylated
  C-term amidated
DDPKLYDKDLGSALGDTVVAWVDAAWSL

SEQ ID NO: 2306 - protein, 28 aa, Artificial Sequence
  Description of Artificial Sequence: Synthetic peptide
  N-term acetylated
DDPKLYDKDLGSALGDTVVAWVDAAWSL

SEQ ID NO: 2307 - protein, 28 aa, Artificial Sequence
  Description of Artificial Sequence: Synthetic peptide
  N-term acetylated
  C-term amidated
DDPKLYDKDLGSALGDTVVAWVDAATSL

SEQ ID NO: 2308 - protein, 28 aa, Artificial Sequence
  Description of Artificial Sequence: Synthetic peptide
  N-term acetylated
DDPKLYDKDLGSALGDTVVAWVDAATSL

SEQ ID NO: 2309 - protein, 28 aa, Artificial Sequence
  Description of Artificial Sequence: Synthetic peptide
  N-term acetylated
  C-term amidated
DDPKLYDKDLGSALGDTVVAWLDAAWSL

SEQ ID NO: 2310 - protein, 28 aa, Artificial Sequence
  Description of Artificial Sequence: Synthetic peptide
  N-term acetylated
DDPKLYDKDLGSALGDTVVAWLDAAWSL

SEQ ID NO: 2311 - protein, 28 aa, Artificial Sequence
  Description of Artificial Sequence: Synthetic peptide
  N-term acetylated
  C-term amidated
DDPKLYDKDLGSALGDTVVAWLDAATSL

SEQ ID NO: 2312 - protein, 28 aa, Artificial Sequence
  Description of Artificial Sequence: Synthetic peptide
  N-term acetylated
DDPKLYDKDLGSALGDTVVAWLDAATSL

SEQ ID NO: 2313 - protein, 28 aa, Artificial Sequence
  Description of Artificial Sequence: Synthetic peptide
  N-term acetylated
  C-term amidated
DDPKLYDKDLGSALGDTVVAWMDAAWSL

SEQ ID NO: 2314 - protein, 28 aa, Artificial Sequence
  Description of Artificial Sequence: Synthetic peptide
  N-term acetylated
DDPKLYDKDLGSALGDTVVAWMDAAWSL

SEQ ID NO: 2315 - protein, 28 aa, Artificial Sequence
  Description of Artificial Sequence: Synthetic peptide
  N-term acetylated
  C-term amidated
DDPKLYDKDLGSALGDTVVAWMDAATSL

SEQ ID NO: 2316 - protein, 28 aa, Artificial Sequence
  Description of Artificial Sequence: Synthetic peptide
  N-term acetylated
DDPKLYDKDLGSALGDTVVAWMDAATSL

SEQ ID NO: 2317 - protein, 28 aa, Artificial Sequence
  Description of Artificial Sequence: Synthetic peptide
  N-term acetylated
  C-term amidated
DDPKLYDKDLGSALGDTVVAQVDAAWSL

SEQ ID NO: 2318 - protein, 28 aa, Artificial Sequence
  Description of Artificial Sequence: Synthetic peptide
  N-term acetylated
DDPKLYDKDLGSALGDTVVAQVDAAWSL

SEQ ID NO: 2319 - protein, 28 aa, Artificial Sequence
  Description of Artificial Sequence: Synthetic peptide
  N-term acetylated
  C-term amidated
DDPKLYDKDLGSALGDTVVAQVDAATSL

SEQ ID NO: 2320 - protein, 28 aa, Artificial Sequence
  Description of Artificial Sequence: Synthetic peptide
  N-term acetylated
DDPKLYDKDLGSALGDTVVAQVDAATSL

SEQ ID NO: 2321 - protein, 28 aa, Artificial Sequence
  Description of Artificial Sequence: Synthetic peptide
  N-term acetylated
  C-term amidated
DDPKLYDKDLGSALGDTVVAQLDAAWSL

SEQ ID NO: 2322 - protein, 28 aa, Artificial Sequence
  Description of Artificial Sequence: Synthetic peptide
  N-term acetylated
DDPKLYDKDLGSALGDTVVAQLDAAWSL

SEQ ID NO: 2323 - protein, 28 aa, Artificial Sequence
  Description of Artificial Sequence: Synthetic peptide
  N-term acetylated
  C-term amidated
DDPKLYDKDLGSALGDTVVAQLDAATSL

SEQ ID NO: 2324 - protein, 28 aa, Artificial Sequence
  Description of Artificial Sequence: Synthetic peptide
  N-term acetylated
DDPKLYDKDLGSALGDTVVAQLDAATSL

SEQ ID NO: 2325 - protein, 28 aa, Artificial Sequence
  Description of Artificial Sequence: Synthetic peptide
  N-term acetylated
  C-term amidated
DDPKLYDKDLGSALGDTVVAQMDAAWSL

SEQ ID NO: 2326 - protein, 28 aa, Artificial Sequence
  Description of Artificial Sequence: Synthetic peptide
  N-term acetylated
DDPKLYDKDLGSALGDTVVAQMDAAWSL

SEQ ID NO: 2327 - protein, 28 aa, Artificial Sequence
  Description of Artificial Sequence: Synthetic peptide
  N-term acetylated
  C-term amidated
DDPKLYDKDLGSALGDTVVAQMDAATSL

SEQ ID NO: 2328 - protein, 28 aa, Artificial Sequence
  Description of Artificial Sequence: Synthetic peptide
  N-term acetylated
DDPKLYDKDLGSALGDTVVAQMDAATSL

SEQ ID NO: 2329 - protein, 28 aa, Artificial Sequence
  Description of Artificial Sequence: Synthetic peptide
  N-term acetylated
  C-term amidated
DDPKLYDKDLGSALGDTVVGWVDAAWSL

SEQ ID NO: 2330 - protein, 28 aa, Artificial Sequence
  Description of Artificial Sequence: Synthetic peptide
  N-term acetylated
DDPKLYDKDLGSALGDTVVGWVDAAWSL

SEQ ID NO: 2331 - protein, 28 aa, Artificial Sequence
  Description of Artificial Sequence: Synthetic peptide
  N-term acetylated
  C-term amidated
DDPKLYDKDLGSALGDTVVGWVDAATSL

SEQ ID NO: 2332 - protein, 28 aa, Artificial Sequence
  Description of Artificial Sequence: Synthetic peptide
  N-term acetylated
DDPKLYDKDLGSALGDTVVGWVDAATSL

SEQ ID NO: 2333 - protein, 28 aa, Artificial Sequence
  Description of Artificial Sequence: Synthetic peptide
  N-term acetylated
  C-term amidated
DDPKLYDKDLGSALGDTVVGWLDAAWSL

SEQ ID NO: 2334 - protein, 28 aa, Artificial Sequence
  Description of Artificial Sequence: Synthetic peptide
  N-term acetylated
DDPKLYDKDLGSALGDTVVGWLDAAWSL

SEQ ID NO: 2335 - protein, 28 aa, Artificial Sequence
  Description of Artificial Sequence: Synthetic peptide
  N-term acetylated
  C-term amidated
DDPKLYDKDLGSALGDTVVGWLDAATSL

SEQ ID NO: 2336 - protein, 28 aa, Artificial Sequence
  Description of Artificial Sequence: Synthetic peptide
  N-term acetylated
DDPKLYDKDLGSALGDTVVGWLDAATSL

SEQ ID NO: 2337 - protein, 28 aa, Artificial Sequence
  Description of Artificial Sequence: Synthetic peptide
  N-term acetylated
  C-term amidated
DDPKLYDKDLGSALGDTVVGWMDAAWSL

SEQ ID NO: 2338 - protein, 28 aa, Artificial Sequence
  Description of Artificial Sequence: Synthetic peptide
  N-term acetylated
DDPKLYDKDLGSALGDTVVGWMDAAWSL

SEQ ID NO: 2339 - protein, 28 aa, Artificial Sequence
  Description of Artificial Sequence: Synthetic peptide
  N-term acetylated
  C-term amidated
DDPKLYDKDLGSALGDTVVGWMDAATSL

SEQ ID NO: 2340 - protein, 28 aa, Artificial Sequence
  Description of Artificial Sequence: Synthetic peptide
  N-term acetylated
DDPKLYDKDLGSALGDTVVGWMDAATSL

SEQ ID NO: 2341 - protein, 28 aa, Artificial Sequence
  Description of Artificial Sequence: Synthetic peptide
  N-term acetylated
  C-term amidated
DDPKLYDKDLGSALGDTVVGQVDAAWSL

SEQ ID NO: 2342 - protein, 28 aa, Artificial Sequence
  Description of Artificial Sequence: Synthetic peptide
  N-term acetylated
DDPKLYDKDLGSALGDTVVGQVDAAWSL

SEQ ID NO: 2343 - protein, 28 aa, Artificial Sequence
  Description of Artificial Sequence: Synthetic peptide
  N-term acetylated
  C-term amidated
DDPKLYDKDLGSALGDTVVGQVDAATSL

SEQ ID NO: 2344 - protein, 28 aa, Artificial Sequence
  Description of Artificial Sequence: Synthetic peptide
  N-term acetylated
DDPKLYDKDLGSALGDTVVGQVDAATSL

SEQ ID NO: 2345 - protein, 28 aa, Artificial Sequence
  Description of Artificial Sequence: Synthetic peptide
  N-term acetylated
  C-term amidated
DDPKLYDKDLGSALGDTVVGQLDAAWSL

SEQ ID NO: 2346 - protein, 28 aa, Artificial Sequence
  Description of Artificial Sequence: Synthetic peptide
  N-term acetylated
DDPKLYDKDLGSALGDTVVGQLDAAWSL

SEQ ID NO: 2347 - protein, 28 aa, Artificial Sequence
  Description of Artificial Sequence: Synthetic peptide
  N-term acetylated
  C-term amidated
DDPKLYDKDLGSALGDTVVGQLDAATSL

SEQ ID NO: 2348 - protein, 28 aa, Artificial Sequence
  Description of Artificial Sequence: Synthetic peptide
  N-term acetylated
DDPKLYDKDLGSALGDTVVGQLDAATSL

SEQ ID NO: 2349 - protein, 28 aa, Artificial Sequence
  Description of Artificial Sequence: Synthetic peptide
  N-term acetylated
  C-term amidated
DDPKLYDKDLGSALGDTVVGQMDAAWSL

SEQ ID NO: 2350 - protein, 28 aa, Artificial Sequence
  Description of Artificial Sequence: Synthetic peptide
  N-term acetylated
DDPKLYDKDLGSALGDTVVGQMDAAWSL

SEQ ID NO: 2351 - protein, 28 aa, Artificial Sequence
  Description of Artificial Sequence: Synthetic peptide
  N-term acetylated
  C-term amidated
DDPKLYDKDLGSALGDTVVGQMDAATSL

SEQ ID NO: 2352 - protein, 28 aa, Artificial Sequence
  Description of Artificial Sequence: Synthetic peptide
  N-term acetylated
DDPKLYDKDLGSALGDTVVGQMDAATSL

SEQ ID NO: 2353 - protein, 28 aa, Artificial Sequence
  Description of Artificial Sequence: Synthetic peptide
  N-term acetylated
  C-term amidated
DDPKLYDKDLGSAMWDWVVAWVDAAWSL

SEQ ID NO: 2354 - protein, 28 aa, Artificial Sequence
  Description of Artificial Sequence: Synthetic peptide
  N-term acetylated
DDPKLYDKDLGSAMWDWVVAWVDAAWSL

SEQ ID NO: 2355 - protein, 28 aa, Artificial Sequence
  Description of Artificial Sequence: Synthetic peptide
  N-term acetylated
  C-term amidated
DDPKLYDKDLGSAMWDWVVAWVDAATSL

SEQ ID NO: 2356 - protein, 28 aa, Artificial Sequence
  Description of Artificial Sequence: Synthetic peptide
  N-term acetylated
DDPKLYDKDLGSAMWDWVVAWVDAATSL

SEQ ID NO: 2357 - protein, 28 aa, Artificial Sequence
  Description of Artificial Sequence: Synthetic peptide
  N-term acetylated
  C-term amidated
DDPKLYDKDLGSAMWDWVVAWLDAAWSL

SEQ ID NO: 2358 - protein, 28 aa, Artificial Sequence
  Description of Artificial Sequence: Synthetic peptide
  N-term acetylated
DDPKLYDKDLGSAMWDWVVAWLDAAWSL

SEQ ID NO: 2359 - protein, 28 aa, Artificial Sequence
  Description of Artificial Sequence: Synthetic peptide
  N-term acetylated
  C-term amidated
DDPKLYDKDLGSAMWDWVVAWLDAATSL

SEQ ID NO: 2360 - protein, 28 aa, Artificial Sequence
  Description of Artificial Sequence: Synthetic peptide
  N-term acetylated
DDPKLYDKDLGSAMWDWVVAWLDAATSL

SEQ ID NO: 2361 - protein, 28 aa, Artificial Sequence
  Description of Artificial Sequence: Synthetic peptide
  N-term acetylated
  C-term amidated
DDPKLYDKDLGSAMWDWVVAWMDAAWSL

SEQ ID NO: 2362 - protein, 28 aa, Artificial Sequence
  Description of Artificial Sequence: Synthetic peptide
  N-term acetylated
DDPKLYDKDLGSAMWDWVVAWMDAAWSL

SEQ ID NO: 2363 - protein, 28 aa, Artificial Sequence
  Description of Artificial Sequence: Synthetic peptide
  N-term acetylated
  C-term amidated
DDPKLYDKDLGSAMWDWVVAWMDAATSL

SEQ ID NO: 2364 - protein, 28 aa, Artificial Sequence
  Description of Artificial Sequence: Synthetic peptide
  N-term acetylated
DDPKLYDKDLGSAMWDWVVAWMDAATSL

SEQ ID NO: 2365 - protein, 28 aa, Artificial Sequence
  Description of Artificial Sequence: Synthetic peptide
  N-term acetylated
  C-term amidated
DDPKLYDKDLGSAMWDWVVAQVDAAWSL

SEQ ID NO: 2366 - protein, 28 aa, Artificial Sequence
  Description of Artificial Sequence: Synthetic peptide
  N-term acetylated
DDPKLYDKDLGSAMWDWVVAQVDAAWSL

SEQ ID NO: 2367 - protein, 28 aa, Artificial Sequence
  Description of Artificial Sequence: Synthetic peptide
  N-term acetylated
  C-term amidated
DDPKLYDKDLGSAMWDWVVAQVDAATSL

SEQ ID NO: 2368 - protein, 28 aa, Artificial Sequence
  Description of Artificial Sequence: Synthetic peptide
  N-term acetylated
DDPKLYDKDLGSAMWDWVVAQVDAATSL

SEQ ID NO: 2369 - protein, 28 aa, Artificial Sequence
  Description of Artificial Sequence: Synthetic peptide
  N-term acetylated
  C-term amidated
DDPKLYDKDLGSAMWDWVVAQLDAAWSL

SEQ ID NO: 2370 - protein, 28 aa, Artificial Sequence
  Description of Artificial Sequence: Synthetic peptide
  N-term acetylated
DDPKLYDKDLGSAMWDWVVAQLDAAWSL

SEQ ID NO: 2371 - protein, 28 aa, Artificial Sequence
  Description of Artificial Sequence: Synthetic peptide
  N-term acetylated
  C-term amidated
DDPKLYDKDLGSAMWDWVVAQLDAATSL

SEQ ID NO: 2372 - protein, 28 aa, Artificial Sequence
  Description of Artificial Sequence: Synthetic peptide
  N-term acetylated
DDPKLYDKDLGSAMWDWVVAQLDAATSL

SEQ ID NO: 2373 - protein, 28 aa, Artificial Sequence
  Description of Artificial Sequence: Synthetic peptide
  N-term acetylated
  C-term amidated
DDPKLYDKDLGSAMWDWVVAQMDAAWSL

SEQ ID NO: 2374 - protein, 28 aa, Artificial Sequence
  Description of Artificial Sequence: Synthetic peptide
  N-term acetylated
DDPKLYDKDLGSAMWDWVVAQMDAAWSL

SEQ ID NO: 2375 - protein, 28 aa, Artificial Sequence
  Description of Artificial Sequence: Synthetic peptide
  N-term acetylated
  C-term amidated
DDPKLYDKDLGSAMWDWVVAQMDAATSL

SEQ ID NO: 2376 - protein, 28 aa, Artificial Sequence
  Description of Artificial Sequence: Synthetic peptide
  N-term acetylated
DDPKLYDKDLGSAMWDWVVAQMDAATSL

SEQ ID NO: 2377 - protein, 28 aa, Artificial Sequence
  Description of Artificial Sequence: Synthetic peptide
  N-term acetylated
  C-term amidated
DDPKLYDKDLGSAMWDWVVGWVDAAWSL

SEQ ID NO: 2378 - protein, 28 aa, Artificial Sequence
  Description of Artificial Sequence: Synthetic peptide
  N-term acetylated
DDPKLYDKDLGSAMWDWVVGWVDAAWSL

SEQ ID NO: 2379 - protein, 28 aa, Artificial Sequence
  Description of Artificial Sequence: Synthetic peptide
  N-term acetylated
  C-term amidated
DDPKLYDKDLGSAMWDWVVGWVDAATSL

SEQ ID NO: 2380 - protein, 28 aa, Artificial Sequence
  Description of Artificial Sequence: Synthetic peptide
  N-term acetylated
DDPKLYDKDLGSAMWDWVVGWVDAATSL

SEQ ID NO: 2381 - protein, 28 aa, Artificial Sequence
  Description of Artificial Sequence: Synthetic peptide
  N-term acetylated
  C-term amidated
DDPKLYDKDLGSAMWDWVVGWLDAAWSL

SEQ ID NO: 2382 - protein, 28 aa, Artificial Sequence
  Description of Artificial Sequence: Synthetic peptide
  N-term acetylated
DDPKLYDKDLGSAMWDWVVGWLDAAWSL

SEQ ID NO: 2383 - protein, 28 aa, Artificial Sequence
  Description of Artificial Sequence: Synthetic peptide
  N-term acetylated
  C-term amidated
DDPKLYDKDLGSAMWDWVVGWLDAATSL

SEQ ID NO: 2384 - protein, 28 aa, Artificial Sequence
  Description of Artificial Sequence: Synthetic peptide
  N-term acetylated
DDPKLYDKDLGSAMWDWVVGWLDAATSL

SEQ ID NO: 2385 - protein, 28 aa, Artificial Sequence
  Description of Artificial Sequence: Synthetic peptide
  N-term acetylated
  C-term amidated
DDPKLYDKDLGSAMWDWVVGWMDAAWSL

SEQ ID NO: 2386 - protein, 28 aa, Artificial Sequence
  Description of Artificial Sequence: Synthetic peptide
  N-term acetylated
DDPKLYDKDLGSAMWDWVVGWMDAAWSL

SEQ ID NO: 2387 - protein, 28 aa, Artificial Sequence
  Description of Artificial Sequence: Synthetic peptide
  N-term acetylated
  C-term amidated
DDPKLYDKDLGSAMWDWVVGWMDAATSL

SEQ ID NO: 2388 - protein, 28 aa, Artificial Sequence
  Description of Artificial Sequence: Synthetic peptide
  N-term acetylated
DDPKLYDKDLGSAMWDWVVGWMDAATSL

SEQ ID NO: 2389 - protein, 28 aa, Artificial Sequence
  Description of Artificial Sequence: Synthetic peptide
  N-term acetylated
  C-term amidated
DDPKLYDKDLGSAMWDWVVGQVDAAWSL

SEQ ID NO: 2390 - protein, 28 aa, Artificial Sequence
  Description of Artificial Sequence: Synthetic peptide
  N-term acetylated
DDPKLYDKDLGSAMWDWVVGQVDAAWSL

SEQ ID NO: 2391 - protein, 28 aa, Artificial Sequence
  Description of Artificial Sequence: Synthetic peptide
  N-term acetylated
  C-term amidated
DDPKLYDKDLGSAMWDWVVGQVDAATSL

SEQ ID NO: 2392 - protein, 28 aa, Artificial Sequence
  Description of Artificial Sequence: Synthetic peptide
  N-term acetylated
DDPKLYDKDLGSAMWDWVVGQVDAATSL

SEQ ID NO: 2393 - protein, 28 aa, Artificial Sequence
  Description of Artificial Sequence: Synthetic peptide
  N-term acetylated
  C-term amidated
DDPKLYDKDLGSAMWDWVVGQLDAAWSL

SEQ ID NO: 2394 - protein, 28 aa, Artificial Sequence
  Description of Artificial Sequence: Synthetic peptide
  N-term acetylated
DDPKLYDKDLGSAMWDWVVGQLDAAWSL

SEQ ID NO: 2395 - protein, 28 aa, Artificial Sequence
  Description of Artificial Sequence: Synthetic peptide
  N-term acetylated
  C-term amidated
DDPKLYDKDLGSAMWDWVVGQLDAATSL

SEQ ID NO: 2396 - protein, 28 aa, Artificial Sequence
  Description of Artificial Sequence: Synthetic peptide
  N-term acetylated
DDPKLYDKDLGSAMWDWVVGQLDAATSL

SEQ ID NO: 2397 - protein, 28 aa, Artificial Sequence
  Description of Artificial Sequence: Synthetic peptide
  N-term acetylated
  C-term amidated
DDPKLYDKDLGSAMWDWVVGQMDAAWSL

SEQ ID NO: 2398 - protein, 28 aa, Artificial Sequence
  Description of Artificial Sequence: Synthetic peptide
  N-term acetylated
DDPKLYDKDLGSAMWDWVVGQMDAAWSL

SEQ ID NO: 2399 - protein, 28 aa, Artificial Sequence
  Description of Artificial Sequence: Synthetic peptide
  N-term acetylated
  C-term amidated
DDPKLYDKDLGSAMWDWVVGQMDAATSL

SEQ ID NO: 2400 - protein, 28 aa, Artificial Sequence
  Description of Artificial Sequence: Synthetic peptide
  N-term acetylated
DDPKLYDKDLGSAMWDWVVGQMDAATSL

SEQ ID NO: 2401 - protein, 28 aa, Artificial Sequence
  Description of Artificial Sequence: Synthetic peptide
  N-term acetylated
  C-term amidated
DDPKLYDKDLGSAMWDTVVAWVDAAWSL

SEQ ID NO: 2402 - protein, 28 aa, Artificial Sequence
  Description of Artificial Sequence: Synthetic peptide
  N-term acetylated
DDPKLYDKDLGSAMWDTVVAWVDAAWSL

SEQ ID NO: 2403 - protein, 28 aa, Artificial Sequence
  Description of Artificial Sequence: Synthetic peptide
  N-term acetylated
  C-term amidated
DDPKLYDKDLGSAMWDTVVAWVDAATSL

SEQ ID NO: 2404 - protein, 28 aa, Artificial Sequence
  Description of Artificial Sequence: Synthetic peptide
  N-term acetylated
DDPKLYDKDLGSAMWDTVVAWVDAATSL

SEQ ID NO: 2405 - protein, 28 aa, Artificial Sequence
  Description of Artificial Sequence: Synthetic peptide
  N-term acetylated
  C-term amidated
DDPKLYDKDLGSAMWDTVVAWLDAAWSL

SEQ ID NO: 2406 - protein, 28 aa, Artificial Sequence
  Description of Artificial Sequence: Synthetic peptide
  N-term acetylated
DDPKLYDKDLGSAMWDTVVAWLDAAWSL

SEQ ID NO: 2407 - protein, 28 aa, Artificial Sequence
  Description of Artificial Sequence: Synthetic peptide
  N-term acetylated
  C-term amidated
DDPKLYDKDLGSAMWDTVVAWLDAATSL

SEQ ID NO: 2408 - protein, 28 aa, Artificial Sequence
  Description of Artificial Sequence: Synthetic peptide
  N-term acetylated
DDPKLYDKDLGSAMWDTVVAWLDAATSL

SEQ ID NO: 2409 - protein, 28 aa, Artificial Sequence
  Description of Artificial Sequence: Synthetic peptide
  N-term acetylated
  C-term amidated
DDPKLYDKDLGSAMWDTVVAWMDAAWSL

SEQ ID NO: 2410 - protein, 28 aa, Artificial Sequence
  Description of Artificial Sequence: Synthetic peptide
  N-term acetylated
DDPKLYDKDLGSAMWDTVVAWMDAAWSL

SEQ ID NO: 2411 - protein, 28 aa, Artificial Sequence
  Description of Artificial Sequence: Synthetic peptide
  N-term acetylated
  C-term amidated
DDPKLYDKDLGSAMWDTVVAWMDAATSL

SEQ ID NO: 2412 - protein, 28 aa, Artificial Sequence
  Description of Artificial Sequence: Synthetic peptide
  N-term acetylated
DDPKLYDKDLGSAMWDTVVAWMDAATSL

SEQ ID NO: 2413 - protein, 28 aa, Artificial Sequence
  Description of Artificial Sequence: Synthetic peptide
  N-term acetylated
  C-term amidated
DDPKLYDKDLGSAMWDTVVAQVDAAWSL

SEQ ID NO: 2414 - protein, 28 aa, Artificial Sequence
  Description of Artificial Sequence: Synthetic peptide
  N-term acetylated
DDPKLYDKDLGSAMWDTVVAQVDAAWSL

SEQ ID NO: 2415 - protein, 28 aa, Artificial Sequence
  Description of Artificial Sequence: Synthetic peptide
  N-term acetylated
  C-term amidated
DDPKLYDKDLGSAMWDTVVAQVDAATSL

SEQ ID NO: 2416 - protein, 28 aa, Artificial Sequence
  Description of Artificial Sequence: Synthetic peptide
  N-term acetylated
DDPKLYDKDLGSAMWDTVVAQVDAATSL

SEQ ID NO: 2417 - protein, 28 aa, Artificial Sequence
  Description of Artificial Sequence: Synthetic peptide
  N-term acetylated
  C-term amidated
DDPKLYDKDLGSAMWDTVVAQLDAAWSL

SEQ ID NO: 2418 - protein, 28 aa, Artificial Sequence
  Description of Artificial Sequence: Synthetic peptide
  N-term acetylated
DDPKLYDKDLGSAMWDTVVAQLDAAWSL

SEQ ID NO: 2419 - protein, 28 aa, Artificial Sequence
  Description of Artificial Sequence: Synthetic peptide
  N-term acetylated
  C-term amidated
DDPKLYDKDLGSAMWDTVVAQLDAATSL

SEQ ID NO: 2420 - protein, 28 aa, Artificial Sequence
  Description of Artificial Sequence: Synthetic peptide
  N-term acetylated
DDPKLYDKDLGSAMWDTVVAQLDAATSL

SEQ ID NO: 2421 - protein, 28 aa, Artificial Sequence
  Description of Artificial Sequence: Synthetic peptide
  N-term acetylated
  C-term amidated
DDPKLYDKDLGSAMWDTVVAQMDAAWSL

SEQ ID NO: 2422 - protein, 28 aa, Artificial Sequence
  Description of Artificial Sequence: Synthetic peptide
  N-term acetylated
DDPKLYDKDLGSAMWDTVVAQMDAAWSL

SEQ ID NO: 2423 - protein, 28 aa, Artificial Sequence
  Description of Artificial Sequence: Synthetic peptide
  N-term acetylated
  C-term amidated
DDPKLYDKDLGSAMWDTVVAQMDAATSL

SEQ ID NO: 2424 - protein, 28 aa, Artificial Sequence
  Description of Artificial Sequence: Synthetic peptide
  N-term acetylated
DDPKLYDKDLGSAMWDTVVAQMDAATSL

SEQ ID NO: 2425 - protein, 28 aa, Artificial Sequence
  Description of Artificial Sequence: Synthetic peptide
  N-term acetylated
  C-term amidated
DDPKLYDKDLGSAMWDTVVGWVDAAWSL

SEQ ID NO: 2426 - protein, 28 aa, Artificial Sequence
  Description of Artificial Sequence: Synthetic peptide
  N-term acetylated
DDPKLYDKDLGSAMWDTVVGWVDAAWSL

SEQ ID NO: 2427 - protein, 28 aa, Artificial Sequence
  Description of Artificial Sequence: Synthetic peptide
  N-term acetylated
  C-term amidated
DDPKLYDKDLGSAMWDTVVGWVDAATSL

SEQ ID NO: 2428 - protein, 28 aa, Artificial Sequence
  Description of Artificial Sequence: Synthetic peptide
  N-term acetylated
DDPKLYDKDLGSAMWDTVVGWVDAATSL

SEQ ID NO: 2429 - protein, 28 aa, Artificial Sequence
  Description of Artificial Sequence: Synthetic peptide
  N-term acetylated
  C-term amidated
DDPKLYDKDLGSAMWDTVVGWLDAAWSL

SEQ ID NO: 2430 - protein, 28 aa, Artificial Sequence
  Description of Artificial Sequence: Synthetic peptide
  N-term acetylated
DDPKLYDKDLGSAMWDTVVGWLDAAWSL

SEQ ID NO: 2431 - protein, 28 aa, Artificial Sequence
  Description of Artificial Sequence: Synthetic peptide
  N-term acetylated
  C-term amidated
DDPKLYDKDLGSAMWDTVVGWLDAATSL

SEQ ID NO: 2432 - protein, 28 aa, Artificial Sequence
  Description of Artificial Sequence: Synthetic peptide
  N-term acetylated
DDPKLYDKDLGSAMWDTVVGWLDAATSL

SEQ ID NO: 2433 - protein, 28 aa, Artificial Sequence
  Description of Artificial Sequence: Synthetic peptide
  N-term acetylated
  C-term amidated
DDPKLYDKDLGSAMWDTVVGWMDAAWSL

SEQ ID NO: 2434 - protein, 28 aa, Artificial Sequence
  Description of Artificial Sequence: Synthetic peptide
  N-term acetylated
DDPKLYDKDLGSAMWDTVVGWMDAAWSL

SEQ ID NO: 2435 - protein, 28 aa, Artificial Sequence
  Description of Artificial Sequence: Synthetic peptide
  N-term acetylated
  C-term amidated
DDPKLYDKDLGSAMWDTVVGWMDAATSL

SEQ ID NO: 2436 - protein, 28 aa, Artificial Sequence
  Description of Artificial Sequence: Synthetic peptide
  N-term acetylated
DDPKLYDKDLGSAMWDTVVGWMDAATSL

SEQ ID NO: 2437 - protein, 28 aa, Artificial Sequence
  Description of Artificial Sequence: Synthetic peptide
  N-term acetylated
  C-term amidated
DDPKLYDKDLGSAMWDTVVGQVDAAWSL

SEQ ID NO: 2438 - protein, 28 aa, Artificial Sequence
  Description of Artificial Sequence: Synthetic peptide
  N-term acetylated
DDPKLYDKDLGSAMWDTVVGQVDAAWSL

SEQ ID NO: 2439 - protein, 28 aa, Artificial Sequence
  Description of Artificial Sequence: Synthetic peptide
  N-term acetylated
  C-term amidated
DDPKLYDKDLGSAMWDTVVGQVDAATSL

SEQ ID NO: 2440 - protein, 28 aa, Artificial Sequence
  Description of Artificial Sequence: Synthetic peptide
  N-term acetylated
DDPKLYDKDLGSAMWDTVVGQVDAATSL

SEQ ID NO: 2441 - protein, 28 aa, Artificial Sequence
  Description of Artificial Sequence: Synthetic peptide
  N-term acetylated
  C-term amidated
DDPKLYDKDLGSAMWDTVVGQLDAAWSL

SEQ ID NO: 2442 - protein, 28 aa, Artificial Sequence
  Description of Artificial Sequence: Synthetic peptide
  N-term acetylated
DDPKLYDKDLGSAMWDTVVGQLDAAWSL

SEQ ID NO: 2443 - protein, 28 aa, Artificial Sequence
  Description of Artificial Sequence: Synthetic peptide
  N-term acetylated
  C-term amidated
DDPKLYDKDLGSAMWDTVVGQLDAATSL

SEQ ID NO: 2444 - protein, 28 aa, Artificial Sequence
  Description of Artificial Sequence: Synthetic peptide
  N-term acetylated
DDPKLYDKDLGSAMWDTVVGQLDAATSL

SEQ ID NO: 2445 - protein, 28 aa, Artificial Sequence
  Description of Artificial Sequence: Synthetic peptide
  N-term acetylated
  C-term amidated
DDPKLYDKDLGSAMWDTVVGQMDAAWSL

SEQ ID NO: 2446 - protein, 28 aa, Artificial Sequence
  Description of Artificial Sequence: Synthetic peptide
  N-term acetylated
DDPKLYDKDLGSAMWDTVVGQMDAAWSL

SEQ ID NO: 2447 - protein, 28 aa, Artificial Sequence
  Description of Artificial Sequence: Synthetic peptide
  N-term acetylated
  C-term amidated
DDPKLYDKDLGSAMWDTVVGQMDAATSL

SEQ ID NO: 2448 - protein, 28 aa, Artificial Sequence
  Description of Artificial Sequence: Synthetic peptide
  N-term acetylated
DDPKLYDKDLGSAMWDTVVGQMDAATSL

SEQ ID NO: 2449 - protein, 28 aa, Artificial Sequence
  Description of Artificial Sequence: Synthetic peptide
  N-term acetylated
  C-term amidated
DDPKLYDKDLGSAMTDWVVAWVDAAWSL

SEQ ID NO: 2450 - protein, 28 aa, Artificial Sequence
  Description of Artificial Sequence: Synthetic peptide
  N-term acetylated
DDPKLYDKDLGSAMTDWVVAWVDAAWSL

SEQ ID NO: 2451 - protein, 28 aa, Artificial Sequence
  Description of Artificial Sequence: Synthetic peptide
  N-term acetylated
  C-term amidated
DDPKLYDKDLGSAMTDWVVAWVDAATSL

SEQ ID NO: 2452 - protein, 28 aa, Artificial Sequence
  Description of Artificial Sequence: Synthetic peptide
  N-term acetylated
DDPKLYDKDLGSAMTDWVVAWVDAATSL

SEQ ID NO: 2453 - protein, 28 aa, Artificial Sequence
  Description of Artificial Sequence: Synthetic peptide
  N-term acetylated
  C-term amidated
DDPKLYDKDLGSAMTDWVVAWLDAAWSL

SEQ ID NO: 2454 - protein, 28 aa, Artificial Sequence
  Description of Artificial Sequence: Synthetic peptide
  N-term acetylated
DDPKLYDKDLGSAMTDWVVAWLDAAWSL

SEQ ID NO: 2455 - protein, 28 aa, Artificial Sequence
  Description of Artificial Sequence: Synthetic peptide
  N-term acetylated
  C-term amidated
DDPKLYDKDLGSAMTDWVVAWLDAATSL

SEQ ID NO: 2456 - protein, 28 aa, Artificial Sequence
  Description of Artificial Sequence: Synthetic peptide
  N-term acetylated
DDPKLYDKDLGSAMTDWVVAWLDAATSL

SEQ ID NO: 2457 - protein, 28 aa, Artificial Sequence
  Description of Artificial Sequence: Synthetic peptide
  N-term acetylated
  C-term amidated
DDPKLYDKDLGSAMTDWVVAWMDAAWSL

SEQ ID NO: 2458 - protein, 28 aa, Artificial Sequence
  Description of Artificial Sequence: Synthetic peptide
  N-term acetylated
DDPKLYDKDLGSAMTDWVVAWMDAAWSL

SEQ ID NO: 2459 - protein, 28 aa, Artificial Sequence
  Description of Artificial Sequence: Synthetic peptide
  N-term acetylated
  C-term amidated
DDPKLYDKDLGSAMTDWVVAWMDAATSL

SEQ ID NO: 2460 - protein, 28 aa, Artificial Sequence
  Description of Artificial Sequence: Synthetic peptide
  N-term acetylated
DDPKLYDKDLGSAMTDWVVAWMDAATSL

SEQ ID NO: 2461 - protein, 28 aa, Artificial Sequence
  Description of Artificial Sequence: Synthetic peptide
  N-term acetylated
  C-term amidated
DDPKLYDKDLGSAMTDWVVAQVDAAWSL

SEQ ID NO: 2462 - protein, 28 aa, Artificial Sequence
  Description of Artificial Sequence: Synthetic peptide
  N-term acetylated
DDPKLYDKDLGSAMTDWVVAQVDAAWSL

SEQ ID NO: 2463 - protein, 28 aa, Artificial Sequence
  Description of Artificial Sequence: Synthetic peptide
  N-term acetylated
  C-term amidated
DDPKLYDKDLGSAMTDWVVAQVDAATSL

SEQ ID NO: 2464 - protein, 28 aa, Artificial Sequence
  Description of Artificial Sequence: Synthetic peptide
  N-term acetylated
DDPKLYDKDLGSAMTDWVVAQVDAATSL

SEQ ID NO: 2465 - protein, 28 aa, Artificial Sequence
  Description of Artificial Sequence: Synthetic peptide
  N-term acetylated
  C-term amidated
DDPKLYDKDLGSAMTDWVVAQLDAAWSL

SEQ ID NO: 2466 - protein, 28 aa, Artificial Sequence
  Description of Artificial Sequence: Synthetic peptide
  N-term acetylated
DDPKLYDKDLGSAMTDWVVAQLDAAWSL

SEQ ID NO: 2467 - protein, 28 aa, Artificial Sequence
  Description of Artificial Sequence: Synthetic peptide
  N-term acetylated
  C-term amidated
DDPKLYDKDLGSAMTDWVVAQLDAATSL

SEQ ID NO: 2468 - protein, 28 aa, Artificial Sequence
  Description of Artificial Sequence: Synthetic peptide
  N-term acetylated
DDPKLYDKDLGSAMTDWVVAQLDAATSL

SEQ ID NO: 2469 - protein, 28 aa, Artificial Sequence
  Description of Artificial Sequence: Synthetic peptide
  N-term acetylated
  C-term amidated
DDPKLYDKDLGSAMTDWVVAQMDAAWSL

SEQ ID NO: 2470 - protein, 28 aa, Artificial Sequence
  Description of Artificial Sequence: Synthetic peptide
  N-term acetylated
DDPKLYDKDLGSAMTDWVVAQMDAAWSL

SEQ ID NO: 2471 - protein, 28 aa, Artificial Sequence
  Description of Artificial Sequence: Synthetic peptide
  N-term acetylated
  C-term amidated
DDPKLYDKDLGSAMTDWVVAQMDAATSL

SEQ ID NO: 2472 - protein, 28 aa, Artificial Sequence
  Description of Artificial Sequence: Synthetic peptide
  N-term acetylated
DDPKLYDKDLGSAMTDWVVAQMDAATSL

SEQ ID NO: 2473 - protein, 28 aa, Artificial Sequence
  Description of Artificial Sequence: Synthetic peptide
  N-term acetylated
  C-term amidated
DDPKLYDKDLGSAMTDWVVGWVDAAWSL

SEQ ID NO: 2474 - protein, 28 aa, Artificial Sequence
  Description of Artificial Sequence: Synthetic peptide
  N-term acetylated
DDPKLYDKDLGSAMTDWVVGWVDAAWSL

SEQ ID NO: 2475 - protein, 28 aa, Artificial Sequence
  Description of Artificial Sequence: Synthetic peptide
  N-term acetylated
  C-term amidated
DDPKLYDKDLGSAMTDWVVGWVDAATSL

SEQ ID NO: 2476 - protein, 28 aa, Artificial Sequence
  Description of Artificial Sequence: Synthetic peptide
  N-term acetylated
DDPKLYDKDLGSAMTDWVVGWVDAATSL

SEQ ID NO: 2477 - protein, 28 aa, Artificial Sequence
  Description of Artificial Sequence: Synthetic peptide
  N-term acetylated
  C-term amidated
DDPKLYDKDLGSAMTDWVVGWLDAAWSL

SEQ ID NO: 2478 - protein, 28 aa, Artificial Sequence
  Description of Artificial Sequence: Synthetic peptide
  N-term acetylated
DDPKLYDKDLGSAMTDWVVGWLDAAWSL

SEQ ID NO: 2479 - protein, 28 aa, Artificial Sequence
  Description of Artificial Sequence: Synthetic peptide
  N-term acetylated
  C-term amidated
DDPKLYDKDLGSAMTDWVVGWLDAATSL

SEQ ID NO: 2480 - protein, 28 aa, Artificial Sequence
  Description of Artificial Sequence: Synthetic peptide
  N-term acetylated
DDPKLYDKDLGSAMTDWVVGWLDAATSL

SEQ ID NO: 2481 - protein, 28 aa, Artificial Sequence
  Description of Artificial Sequence: Synthetic peptide
  N-term acetylated
  C-term amidated
DDPKLYDKDLGSAMTDWVVGWMDAAWSL

SEQ ID NO: 2482 - protein, 28 aa, Artificial Sequence
  Description of Artificial Sequence: Synthetic peptide
  N-term acetylated
DDPKLYDKDLGSAMTDWVVGWMDAAWSL

SEQ ID NO: 2483 - protein, 28 aa, Artificial Sequence
  Description of Artificial Sequence: Synthetic peptide
  N-term acetylated
  C-term amidated
DDPKLYDKDLGSAMTDWVVGWMDAATSL

SEQ ID NO: 2484 - protein, 28 aa, Artificial Sequence
  Description of Artificial Sequence: Synthetic peptide
  N-term acetylated
DDPKLYDKDLGSAMTDWVVGWMDAATSL

SEQ ID NO: 2485 - protein, 28 aa, Artificial Sequence
  Description of Artificial Sequence: Synthetic peptide
  N-term acetylated
  C-term amidated
DDPKLYDKDLGSAMTDWVVGQVDAAWSL

SEQ ID NO: 2486 - protein, 28 aa, Artificial Sequence
  Description of Artificial Sequence: Synthetic peptide
  N-term acetylated
DDPKLYDKDLGSAMTDWVVGQVDAAWSL

SEQ ID NO: 2487 - protein, 28 aa, Artificial Sequence
  Description of Artificial Sequence: Synthetic peptide
  N-term acetylated
  C-term amidated
DDPKLYDKDLGSAMTDWVVGQVDAATSL

SEQ ID NO: 2488 - protein, 28 aa, Artificial Sequence
  Description of Artificial Sequence: Synthetic peptide
  N-term acetylated
DDPKLYDKDLGSAMTDWVVGQVDAATSL

SEQ ID NO: 2489 - protein, 28 aa, Artificial Sequence
  Description of Artificial Sequence: Synthetic peptide
  N-term acetylated
  C-term amidated
DDPKLYDKDLGSAMTDWVVGQLDAAWSL

SEQ ID NO: 2490 - protein, 28 aa, Artificial Sequence
  Description of Artificial Sequence: Synthetic peptide
  N-term acetylated
DDPKLYDKDLGSAMTDWVVGQLDAAWSL

SEQ ID NO: 2491 - protein, 28 aa, Artificial Sequence
  Description of Artificial Sequence: Synthetic peptide
  N-term acetylated
  C-term amidated
DDPKLYDKDLGSAMTDWVVGQLDAATSL

SEQ ID NO: 2492 - protein, 28 aa, Artificial Sequence
  Description of Artificial Sequence: Synthetic peptide
  N-term acetylated
DDPKLYDKDLGSAMTDWVVGQLDAATSL

SEQ ID NO: 2493 - protein, 28 aa, Artificial Sequence
  Description of Artificial Sequence: Synthetic peptide
  N-term acetylated
  C-term amidated
DDPKLYDKDLGSAMTDWVVGQMDAAWSL

SEQ ID NO: 2494 - protein, 28 aa, Artificial Sequence
  Description of Artificial Sequence: Synthetic peptide
  N-term acetylated
DDPKLYDKDLGSAMTDWVVGQMDAAWSL

SEQ ID NO: 2495 - protein, 28 aa, Artificial Sequence
  Description of Artificial Sequence: Synthetic peptide
  N-term acetylated
  C-term amidated
DDPKLYDKDLGSAMTDWVVGQMDAATSL

SEQ ID NO: 2496 - protein, 28 aa, Artificial Sequence
  Description of Artificial Sequence: Synthetic peptide
  N-term acetylated
DDPKLYDKDLGSAMTDWVVGQMDAATSL

SEQ ID NO: 2497 - protein, 28 aa, Artificial Sequence
  Description of Artificial Sequence: Synthetic peptide
  N-term acetylated
  C-term amidated
DDPKLYDKDLGSAMTDTVVAWVDAAWSL

SEQ ID NO: 2498 - protein, 28 aa, Artificial Sequence
  Description of Artificial Sequence: Synthetic peptide
  N-term acetylated
DDPKLYDKDLGSAMTDTVVAWVDAAWSL

SEQ ID NO: 2499 - protein, 28 aa, Artificial Sequence
  Description of Artificial Sequence: Synthetic peptide
  N-term acetylated
  C-term amidated
DDPKLYDKDLGSAMTDTVVAWVDAATSL

SEQ ID NO: 2500 - protein, 28 aa, Artificial Sequence
  Description of Artificial Sequence: Synthetic peptide
  N-term acetylated
DDPKLYDKDLGSAMTDTVVAWVDAATSL

SEQ ID NO: 2501 - protein, 28 aa, Artificial Sequence
  Description of Artificial Sequence: Synthetic peptide
  N-term acetylated
  C-term amidated
DDPKLYDKDLGSAMTDTVVAWLDAAWSL

SEQ ID NO: 2502 - protein, 28 aa, Artificial Sequence
  Description of Artificial Sequence: Synthetic peptide
  N-term acetylated
DDPKLYDKDLGSAMTDTVVAWLDAAWSL

SEQ ID NO: 2503 - protein, 28 aa, Artificial Sequence
  Description of Artificial Sequence: Synthetic peptide
  N-term acetylated
  C-term amidated
DDPKLYDKDLGSAMTDTVVAWLDAATSL

SEQ ID NO: 2504 - protein, 28 aa, Artificial Sequence
  Description of Artificial Sequence: Synthetic peptide
  N-term acetylated
DDPKLYDKDLGSAMTDTVVAWLDAATSL

SEQ ID NO: 2505 - protein, 28 aa, Artificial Sequence
  Description of Artificial Sequence: Synthetic peptide
  N-term acetylated
  C-term amidated
DDPKLYDKDLGSAMTDTVVAWMDAAWSL

SEQ ID NO: 2506 - protein, 28 aa, Artificial Sequence
  Description of Artificial Sequence: Synthetic peptide
  N-term acetylated
DDPKLYDKDLGSAMTDTVVAWMDAAWSL

SEQ ID NO: 2507 - protein, 28 aa, Artificial Sequence
  Description of Artificial Sequence: Synthetic peptide
  N-term acetylated
  C-term amidated
DDPKLYDKDLGSAMTDTVVAWMDAATSL

SEQ ID NO: 2508 - protein, 28 aa, Artificial Sequence
  Description of Artificial Sequence: Synthetic peptide
  N-term acetylated
DDPKLYDKDLGSAMTDTVVAWMDAATSL

SEQ ID NO: 2509 - protein, 28 aa, Artificial Sequence
  Description of Artificial Sequence: Synthetic peptide
  N-term acetylated
  C-term amidated
DDPKLYDKDLGSAMTDTVVAQVDAAWSL

SEQ ID NO: 2510 - protein, 28 aa, Artificial Sequence
  Description of Artificial Sequence: Synthetic peptide
  N-term acetylated
DDPKLYDKDLGSAMTDTVVAQVDAAWSL

SEQ ID NO: 2511 - protein, 28 aa, Artificial Sequence
  Description of Artificial Sequence: Synthetic peptide
  N-term acetylated
  C-term amidated
DDPKLYDKDLGSAMTDTVVAQVDAATSL

SEQ ID NO: 2512 - protein, 28 aa, Artificial Sequence
  Description of Artificial Sequence: Synthetic peptide
  N-term acetylated
DDPKLYDKDLGSAMTDTVVAQVDAATSL

SEQ ID NO: 2513 - protein, 28 aa, Artificial Sequence
  Description of Artificial Sequence: Synthetic peptide
  N-term acetylated
  C-term amidated
DDPKLYDKDLGSAMTDTVVAQLDAAWSL

SEQ ID NO: 2514 - protein, 28 aa, Artificial Sequence
  Description of Artificial Sequence: Synthetic peptide
  N-term acetylated
DDPKLYDKDLGSAMTDTVVAQLDAAWSL

SEQ ID NO: 2515 - protein, 28 aa, Artificial Sequence
  Description of Artificial Sequence: Synthetic peptide
  N-term acetylated
  C-term amidated
DDPKLYDKDLGSAMTDTVVAQLDAATSL

SEQ ID NO: 2516 - protein, 28 aa, Artificial Sequence
  Description of Artificial Sequence: Synthetic peptide
  N-term acetylated
DDPKLYDKDLGSAMTDTVVAQLDAATSL

SEQ ID NO: 2517 - protein, 28 aa, Artificial Sequence
  Description of Artificial Sequence: Synthetic peptide
  N-term acetylated
  C-term amidated
DDPKLYDKDLGSAMTDTVVAQMDAAWSL

SEQ ID NO: 2518 - protein, 28 aa, Artificial Sequence
  Description of Artificial Sequence: Synthetic peptide
  N-term acetylated
DDPKLYDKDLGSAMTDTVVAQMDAAWSL

SEQ ID NO: 2519 - protein, 28 aa, Artificial Sequence
  Description of Artificial Sequence: Synthetic peptide
  N-term acetylated
  C-term amidated
DDPKLYDKDLGSAMTDTVVAQMDAATSL

SEQ ID NO: 2520 - protein, 28 aa, Artificial Sequence
  Description of Artificial Sequence: Synthetic peptide
  N-term acetylated
DDPKLYDKDLGSAMTDTVVAQMDAATSL

SEQ ID NO: 2521 - protein, 28 aa, Artificial Sequence
  Description of Artificial Sequence: Synthetic peptide
  N-term acetylated
  C-term amidated
DDPKLYDKDLGSAMTDTVVGWVDAAWSL

SEQ ID NO: 2522 - protein, 28 aa, Artificial Sequence
  Description of Artificial Sequence: Synthetic peptide
  N-term acetylated
DDPKLYDKDLGSAMTDTVVGWVDAAWSL

SEQ ID NO: 2523 - protein, 28 aa, Artificial Sequence
  Description of Artificial Sequence: Synthetic peptide
  N-term acetylated
  C-term amidated
DDPKLYDKDLGSAMTDTVVGWVDAATSL

SEQ ID NO: 2524 - protein, 28 aa, Artificial Sequence
  Description of Artificial Sequence: Synthetic peptide
  N-term acetylated
DDPKLYDKDLGSAMTDTVVGWVDAATSL

SEQ ID NO: 2525 - protein, 28 aa, Artificial Sequence
  Description of Artificial Sequence: Synthetic peptide
  N-term acetylated
  C-term amidated
DDPKLYDKDLGSAMTDTVVGWLDAAWSL

SEQ ID NO: 2526 - protein, 28 aa, Artificial Sequence
  Description of Artificial Sequence: Synthetic peptide
  N-term acetylated
DDPKLYDKDLGSAMTDTVVGWLDAAWSL

SEQ ID NO: 2527 - protein, 28 aa, Artificial Sequence
  Description of Artificial Sequence: Synthetic peptide
  N-term acetylated
  C-term amidated
DDPKLYDKDLGSAMTDTVVGWLDAATSL

SEQ ID NO: 2528 - protein, 28 aa, Artificial Sequence
  Description of Artificial Sequence: Synthetic peptide
  N-term acetylated
DDPKLYDKDLGSAMTDTVVGWLDAATSL

SEQ ID NO: 2529 - protein, 28 aa, Artificial Sequence
  Description of Artificial Sequence: Synthetic peptide
  N-term acetylated
  C-term amidated
DDPKLYDKDLGSAMTDTVVGWMDAAWSL

SEQ ID NO: 2530 - protein, 28 aa, Artificial Sequence
  Description of Artificial Sequence: Synthetic peptide
  N-term acetylated
DDPKLYDKDLGSAMTDTVVGWMDAAWSL

SEQ ID NO: 2531 - protein, 28 aa, Artificial Sequence
  Description of Artificial Sequence: Synthetic peptide
  N-term acetylated
  C-term amidated
DDPKLYDKDLGSAMTDTVVGWMDAATSL

SEQ ID NO: 2532 - protein, 28 aa, Artificial Sequence
  Description of Artificial Sequence: Synthetic peptide
  N-term acetylated
DDPKLYDKDLGSAMTDTVVGWMDAATSL

SEQ ID NO: 2533 - protein, 28 aa, Artificial Sequence
  Description of Artificial Sequence: Synthetic peptide
  N-term acetylated
  C-term amidated
DDPKLYDKDLGSAMTDTVVGQVDAAWSL

SEQ ID NO: 2534 - protein, 28 aa, Artificial Sequence
  Description of Artificial Sequence: Synthetic peptide
  N-term acetylated
DDPKLYDKDLGSAMTDTVVGQVDAAWSL

SEQ ID NO: 2535 - protein, 28 aa, Artificial Sequence
  Description of Artificial Sequence: Synthetic peptide
  N-term acetylated
  C-term amidated
DDPKLYDKDLGSAMTDTVVGQVDAATSL

SEQ ID NO: 2536 - protein, 28 aa, Artificial Sequence
  Description of Artificial Sequence: Synthetic peptide
  N-term acetylated
DDPKLYDKDLGSAMTDTVVGQVDAATSL

SEQ ID NO: 2537 - protein, 28 aa, Artificial Sequence
  Description of Artificial Sequence: Synthetic peptide
  N-term acetylated
  C-term amidated
DDPKLYDKDLGSAMTDTVVGQLDAAWSL

SEQ ID NO: 2538 - protein, 28 aa, Artificial Sequence
  Description of Artificial Sequence: Synthetic peptide
  N-term acetylated
DDPKLYDKDLGSAMTDTVVGQLDAAWSL

SEQ ID NO: 2539 - protein, 28 aa, Artificial Sequence
  Description of Artificial Sequence: Synthetic peptide
  N-term acetylated
  C-term amidated
DDPKLYDKDLGSAMTDTVVGQLDAATSL

SEQ ID NO: 2540 - protein, 28 aa, Artificial Sequence
  Description of Artificial Sequence: Synthetic peptide
  N-term acetylated
DDPKLYDKDLGSAMTDTVVGQLDAATSL

SEQ ID NO: 2541 - protein, 28 aa, Artificial Sequence
  Description of Artificial Sequence: Synthetic peptide
  N-term acetylated
  C-term amidated
DDPKLYDKDLGSAMTDTVVGQMDAAWSL

SEQ ID NO: 2542 - protein, 28 aa, Artificial Sequence
  Description of Artificial Sequence: Synthetic peptide
  N-term acetylated
DDPKLYDKDLGSAMTDTVVGQMDAAWSL

SEQ ID NO: 2543 - protein, 28 aa, Artificial Sequence
  Description of Artificial Sequence: Synthetic peptide
  N-term acetylated
  C-term amidated
DDPKLYDKDLGSAMTDTVVGQMDAATSL

SEQ ID NO: 2544 - protein, 28 aa, Artificial Sequence
  Description of Artificial Sequence: Synthetic peptide
  N-term acetylated
DDPKLYDKDLGSAMTDTVVGQMDAATSL

SEQ ID NO: 2545 - protein, 28 aa, Artificial Sequence
  Description of Artificial Sequence: Synthetic peptide
  N-term acetylated
  C-term amidated
DDPKLYDKDLGSAMGDWVVAWVDAAWSL

SEQ ID NO: 2546 - protein, 28 aa, Artificial Sequence
  Description of Artificial Sequence: Synthetic peptide
  N-term acetylated
DDPKLYDKDLGSAMGDWVVAWVDAAWSL

SEQ ID NO: 2547 - protein, 28 aa, Artificial Sequence
  Description of Artificial Sequence: Synthetic peptide
  N-term acetylated
  C-term amidated
DDPKLYDKDLGSAMGDWVVAWVDAATSL

SEQ ID NO: 2548 - protein, 28 aa, Artificial Sequence
  Description of Artificial Sequence: Synthetic peptide
  N-term acetylated
DDPKLYDKDLGSAMGDWVVAWVDAATSL

SEQ ID NO: 2549 - protein, 28 aa, Artificial Sequence
  Description of Artificial Sequence: Synthetic peptide
  N-term acetylated
  C-term amidated
DDPKLYDKDLGSAMGDWVVAWLDAAWSL

SEQ ID NO: 2550 - protein, 28 aa, Artificial Sequence
  Description of Artificial Sequence: Synthetic peptide
  N-term acetylated
DDPKLYDKDLGSAMGDWVVAWLDAAWSL

SEQ ID NO: 2551 - protein, 28 aa, Artificial Sequence
  Description of Artificial Sequence: Synthetic peptide
  N-term acetylated
  C-term amidated
DDPKLYDKDLGSAMGDWVVAWLDAATSL

SEQ ID NO: 2552 - protein, 28 aa, Artificial Sequence
  Description of Artificial Sequence: Synthetic peptide
  N-term acetylated
DDPKLYDKDLGSAMGDWVVAWLDAATSL

SEQ ID NO: 2553 - protein, 28 aa, Artificial Sequence
  Description of Artificial Sequence: Synthetic peptide
  N-term acetylated
  C-term amidated
DDPKLYDKDLGSAMGDWVVAWMDAAWSL

SEQ ID NO: 2554 - protein, 28 aa, Artificial Sequence
  Description of Artificial Sequence: Synthetic peptide
  N-term acetylated
DDPKLYDKDLGSAMGDWVVAWMDAAWSL

SEQ ID NO: 2555 - protein, 28 aa, Artificial Sequence
  Description of Artificial Sequence: Synthetic peptide
  N-term acetylated
  C-term amidated
DDPKLYDKDLGSAMGDWVVAWMDAATSL

SEQ ID NO: 2556 - protein, 28 aa, Artificial Sequence
  Description of Artificial Sequence: Synthetic peptide
  N-term acetylated
DDPKLYDKDLGSAMGDWVVAWMDAATSL

SEQ ID NO: 2557 - protein, 28 aa, Artificial Sequence
  Description of Artificial Sequence: Synthetic peptide
  N-term acetylated
  C-term amidated
DDPKLYDKDLGSAMGDWVVAQVDAAWSL

SEQ ID NO: 2558 - protein, 28 aa, Artificial Sequence
  Description of Artificial Sequence: Synthetic peptide
  N-term acetylated
DDPKLYDKDLGSAMGDWVVAQVDAAWSL

SEQ ID NO: 2559 - protein, 28 aa, Artificial Sequence
  Description of Artificial Sequence: Synthetic peptide
  N-term acetylated
  C-term amidated
DDPKLYDKDLGSAMGDWVVAQVDAATSL

SEQ ID NO: 2560 - protein, 28 aa, Artificial Sequence
  Description of Artificial Sequence: Synthetic peptide
  N-term acetylated
DDPKLYDKDLGSAMGDWVVAQVDAATSL

SEQ ID NO: 2561 - protein, 28 aa, Artificial Sequence
  Description of Artificial Sequence: Synthetic peptide
  N-term acetylated
  C-term amidated
DDPKLYDKDLGSAMGDWVVAQLDAAWSL

SEQ ID NO: 2562 - protein, 28 aa, Artificial Sequence
  Description of Artificial Sequence: Synthetic peptide
  N-term acetylated
DDPKLYDKDLGSAMGDWVVAQLDAAWSL

SEQ ID NO: 2563 - protein, 28 aa, Artificial Sequence
  Description of Artificial Sequence: Synthetic peptide
  N-term acetylated
  C-term amidated
DDPKLYDKDLGSAMGDWVVAQLDAATSL

SEQ ID NO: 2564 - protein, 28 aa, Artificial Sequence
  Description of Artificial Sequence: Synthetic peptide
  N-term acetylated
DDPKLYDKDLGSAMGDWVVAQLDAATSL

SEQ ID NO: 2565 - protein, 28 aa, Artificial Sequence
  Description of Artificial Sequence: Synthetic peptide
  N-term acetylated
  C-term amidated
DDPKLYDKDLGSAMGDWVVAQMDAAWSL

SEQ ID NO: 2566 - protein, 28 aa, Artificial Sequence
  Description of Artificial Sequence: Synthetic peptide
  N-term acetylated
DDPKLYDKDLGSAMGDWVVAQMDAAWSL

SEQ ID NO: 2567 - protein, 28 aa, Artificial Sequence
  Description of Artificial Sequence: Synthetic peptide
  N-term acetylated
  C-term amidated
DDPKLYDKDLGSAMGDWVVAQMDAATSL

SEQ ID NO: 2568 - protein, 28 aa, Artificial Sequence
  Description of Artificial Sequence: Synthetic peptide
  N-term acetylated
DDPKLYDKDLGSAMGDWVVAQMDAATSL

SEQ ID NO: 2569 - protein, 28 aa, Artificial Sequence
  Description of Artificial Sequence: Synthetic peptide
  N-term acetylated
  C-term amidated
DDPKLYDKDLGSAMGDWVVGWVDAAWSL

SEQ ID NO: 2570 - protein, 28 aa, Artificial Sequence
  Description of Artificial Sequence: Synthetic peptide
  N-term acetylated
DDPKLYDKDLGSAMGDWVVGWVDAAWSL

SEQ ID NO: 2571 - protein, 28 aa, Artificial Sequence
  Description of Artificial Sequence: Synthetic peptide
  N-term acetylated
  C-term amidated
DDPKLYDKDLGSAMGDWVVGWVDAATSL

SEQ ID NO: 2572 - protein, 28 aa, Artificial Sequence
  Description of Artificial Sequence: Synthetic peptide
  N-term acetylated
DDPKLYDKDLGSAMGDWVVGWVDAATSL

SEQ ID NO: 2573 - protein, 28 aa, Artificial Sequence
  Description of Artificial Sequence: Synthetic peptide
  N-term acetylated
  C-term amidated
DDPKLYDKDLGSAMGDWVVGWLDAAWSL

SEQ ID NO: 2574 - protein, 28 aa, Artificial Sequence
  Description of Artificial Sequence: Synthetic peptide
  N-term acetylated
DDPKLYDKDLGSAMGDWVVGWLDAAWSL

SEQ ID NO: 2575 - protein, 28 aa, Artificial Sequence
  Description of Artificial Sequence: Synthetic peptide
  N-term acetylated
  C-term amidated
DDPKLYDKDLGSAMGDWVVGWLDAATSL

SEQ ID NO: 2576 - protein, 28 aa, Artificial Sequence
  Description of Artificial Sequence: Synthetic peptide
  N-term acetylated
DDPKLYDKDLGSAMGDWVVGWLDAATSL

SEQ ID NO: 2577 - protein, 28 aa, Artificial Sequence
  Description of Artificial Sequence: Synthetic peptide
  N-term acetylated
  C-term amidated
DDPKLYDKDLGSAMGDWVVGWMDAAWSL

SEQ ID NO: 2578 - protein, 28 aa, Artificial Sequence
  Description of Artificial Sequence: Synthetic peptide
  N-term acetylated
DDPKLYDKDLGSAMGDWVVGWMDAAWSL

SEQ ID NO: 2579 - protein, 28 aa, Artificial Sequence
  Description of Artificial Sequence: Synthetic peptide
  N-term acetylated
  C-term amidated
DDPKLYDKDLGSAMGDWVVGWMDAATSL

SEQ ID NO: 2580 - protein, 28 aa, Artificial Sequence
  Description of Artificial Sequence: Synthetic peptide
  N-term acetylated
DDPKLYDKDLGSAMGDWVVGWMDAATSL

SEQ ID NO: 2581 - protein, 28 aa, Artificial Sequence
  Description of Artificial Sequence: Synthetic peptide
  N-term acetylated
  C-term amidated
DDPKLYDKDLGSAMGDWVVGQVDAAWSL

SEQ ID NO: 2582 - protein, 28 aa, Artificial Sequence
  Description of Artificial Sequence: Synthetic peptide
  N-term acetylated
DDPKLYDKDLGSAMGDWVVGQVDAAWSL

SEQ ID NO: 2583 - protein, 28 aa, Artificial Sequence
  Description of Artificial Sequence: Synthetic peptide
  N-term acetylated
  C-term amidated
DDPKLYDKDLGSAMGDWVVGQVDAATSL

SEQ ID NO: 2584 - protein, 28 aa, Artificial Sequence
  Description of Artificial Sequence: Synthetic peptide
  N-term acetylated
DDPKLYDKDLGSAMGDWVVGQVDAATSL

SEQ ID NO: 2585 - protein, 28 aa, Artificial Sequence
  Description of Artificial Sequence: Synthetic peptide
  N-term acetylated
  C-term amidated
DDPKLYDKDLGSAMGDWVVGQLDAAWSL

SEQ ID NO: 2586 - protein, 28 aa, Artificial Sequence
  Description of Artificial Sequence: Synthetic peptide
  N-term acetylated
DDPKLYDKDLGSAMGDWVVGQLDAAWSL

SEQ ID NO: 2587 - protein, 28 aa, Artificial Sequence
  Description of Artificial Sequence: Synthetic peptide
  N-term acetylated
  C-term amidated
DDPKLYDKDLGSAMGDWVVGQLDAATSL

SEQ ID NO: 2588 - protein, 28 aa, Artificial Sequence
  Description of Artificial Sequence: Synthetic peptide
  N-term acetylated
DDPKLYDKDLGSAMGDWVVGQLDAATSL

SEQ ID NO: 2589 - protein, 28 aa, Artificial Sequence
  Description of Artificial Sequence: Synthetic peptide
  N-term acetylated
  C-term amidated
DDPKLYDKDLGSAMGDWVVGQMDAAWSL

SEQ ID NO: 2590 - protein, 28 aa, Artificial Sequence
  Description of Artificial Sequence: Synthetic peptide
  N-term acetylated
DDPKLYDKDLGSAMGDWVVGQMDAAWSL

SEQ ID NO: 2591 - protein, 28 aa, Artificial Sequence
  Description of Artificial Sequence: Synthetic peptide
  N-term acetylated
  C-term amidated
DDPKLYDKDLGSAMGDWVVGQMDAATSL

SEQ ID NO: 2592 - protein, 28 aa, Artificial Sequence
  Description of Artificial Sequence: Synthetic peptide
  N-term acetylated
DDPKLYDKDLGSAMGDWVVGQMDAATSL

SEQ ID NO: 2593 - protein, 28 aa, Artificial Sequence
  Description of Artificial Sequence: Synthetic peptide
  N-term acetylated
  C-term amidated
DDPKLYDKDLGSAMGDTVVAWVDAAWSL

SEQ ID NO: 2594 - protein, 28 aa, Artificial Sequence
  Description of Artificial Sequence: Synthetic peptide
  N-term acetylated
DDPKLYDKDLGSAMGDTVVAWVDAAWSL

SEQ ID NO: 2595 - protein, 28 aa, Artificial Sequence
  Description of Artificial Sequence: Synthetic peptide
  N-term acetylated
  C-term amidated
DDPKLYDKDLGSAMGDTVVAWVDAATSL

SEQ ID NO: 2596 - protein, 28 aa, Artificial Sequence
  Description of Artificial Sequence: Synthetic peptide
  N-term acetylated
DDPKLYDKDLGSAMGDTVVAWVDAATSL

SEQ ID NO: 2597 - protein, 28 aa, Artificial Sequence
  Description of Artificial Sequence: Synthetic peptide
  N-term acetylated
  C-term amidated
DDPKLYDKDLGSAMGDTVVAWLDAAWSL

SEQ ID NO: 2598 - protein, 28 aa, Artificial Sequence
  Description of Artificial Sequence: Synthetic peptide
  N-term acetylated
DDPKLYDKDLGSAMGDTVVAWLDAAWSL

SEQ ID NO: 2599 - protein, 28 aa, Artificial Sequence
  Description of Artificial Sequence: Synthetic peptide
  N-term acetylated
  C-term amidated
DDPKLYDKDLGSAMGDTVVAWLDAATSL

SEQ ID NO: 2600 - protein, 28 aa, Artificial Sequence
  Description of Artificial Sequence: Synthetic peptide
  N-term acetylated
DDPKLYDKDLGSAMGDTVVAWLDAATSL

SEQ ID NO: 2601 - protein, 28 aa, Artificial Sequence
  Description of Artificial Sequence: Synthetic peptide
  N-term acetylated
  C-term amidated
DDPKLYDKDLGSAMGDTVVAWMDAAWSL

SEQ ID NO: 2602 - protein, 28 aa, Artificial Sequence
  Description of Artificial Sequence: Synthetic peptide
  N-term acetylated
DDPKLYDKDLGSAMGDTVVAWMDAAWSL

SEQ ID NO: 2603 - protein, 28 aa, Artificial Sequence
  Description of Artificial Sequence: Synthetic peptide
  N-term acetylated
  C-term amidated
DDPKLYDKDLGSAMGDTVVAWMDAATSL

SEQ ID NO: 2604 - protein, 28 aa, Artificial Sequence
  Description of Artificial Sequence: Synthetic peptide
  N-term acetylated
DDPKLYDKDLGSAMGDTVVAWMDAATSL

SEQ ID NO: 2605 - protein, 28 aa, Artificial Sequence
  Description of Artificial Sequence: Synthetic peptide
  N-term acetylated
  C-term amidated
DDPKLYDKDLGSAMGDTVVAQVDAAWSL

SEQ ID NO: 2606 - protein, 28 aa, Artificial Sequence
  Description of Artificial Sequence: Synthetic peptide
  N-term acetylated
DDPKLYDKDLGSAMGDTVVAQVDAAWSL

SEQ ID NO: 2607 - protein, 28 aa, Artificial Sequence
  Description of Artificial Sequence: Synthetic peptide
  N-term acetylated
  C-term amidated
DDPKLYDKDLGSAMGDTVVAQVDAATSL

SEQ ID NO: 2608 - protein, 28 aa, Artificial Sequence
  Description of Artificial Sequence: Synthetic peptide
  N-term acetylated
DDPKLYDKDLGSAMGDTVVAQVDAATSL

SEQ ID NO: 2609 - protein, 28 aa, Artificial Sequence
  Description of Artificial Sequence: Synthetic peptide
  N-term acetylated
  C-term amidated
DDPKLYDKDLGSAMGDTVVAQLDAAWSL

SEQ ID NO: 2610 - protein, 28 aa, Artificial Sequence
  Description of Artificial Sequence: Synthetic peptide
  N-term acetylated
DDPKLYDKDLGSAMGDTVVAQLDAAWSL

SEQ ID NO: 2611 - protein, 28 aa, Artificial Sequence
  Description of Artificial Sequence: Synthetic peptide
  N-term acetylated
  C-term amidated
DDPKLYDKDLGSAMGDTVVAQLDAATSL

SEQ ID NO: 2612 - protein, 28 aa, Artificial Sequence
  Description of Artificial Sequence: Synthetic peptide
  N-term acetylated
DDPKLYDKDLGSAMGDTVVAQLDAATSL

SEQ ID NO: 2613 - protein, 28 aa, Artificial Sequence
  Description of Artificial Sequence: Synthetic peptide
  N-term acetylated
  C-term amidated
DDPKLYDKDLGSAMGDTVVAQMDAAWSL

SEQ ID NO: 2614 - protein, 28 aa, Artificial Sequence
  Description of Artificial Sequence: Synthetic peptide
  N-term acetylated
DDPKLYDKDLGSAMGDTVVAQMDAAWSL

SEQ ID NO: 2615 - protein, 28 aa, Artificial Sequence
  Description of Artificial Sequence: Synthetic peptide
  N-term acetylated
  C-term amidated
DDPKLYDKDLGSAMGDTVVAQMDAATSL

SEQ ID NO: 2616 - protein, 28 aa, Artificial Sequence
  Description of Artificial Sequence: Synthetic peptide
  N-term acetylated
DDPKLYDKDLGSAMGDTVVAQMDAATSL

SEQ ID NO: 2617 - protein, 28 aa, Artificial Sequence
  Description of Artificial Sequence: Synthetic peptide
  N-term acetylated
  C-term amidated
DDPKLYDKDLGSAMGDTVVGWVDAAWSL

SEQ ID NO: 2618 - protein, 28 aa, Artificial Sequence
  Description of Artificial Sequence: Synthetic peptide
  N-term acetylated
DDPKLYDKDLGSAMGDTVVGWVDAAWSL

SEQ ID NO: 2619 - protein, 28 aa, Artificial Sequence
  Description of Artificial Sequence: Synthetic peptide
  N-term acetylated
  C-term amidated
DDPKLYDKDLGSAMGDTVVGWVDAATSL

SEQ ID NO: 2620 - protein, 28 aa, Artificial Sequence
  Description of Artificial Sequence: Synthetic peptide
  N-term acetylated
DDPKLYDKDLGSAMGDTVVGWVDAATSL

SEQ ID NO: 2621 - protein, 28 aa, Artificial Sequence
  Description of Artificial Sequence: Synthetic peptide
  N-term acetylated
  C-term amidated
DDPKLYDKDLGSAMGDTVVGWLDAAWSL

SEQ ID NO: 2622 - protein, 28 aa, Artificial Sequence
  Description of Artificial Sequence: Synthetic peptide
  N-term acetylated
DDPKLYDKDLGSAMGDTVVGWLDAAWSL

SEQ ID NO: 2623 - protein, 28 aa, Artificial Sequence
  Description of Artificial Sequence: Synthetic peptide
  N-term acetylated
  C-term amidated
DDPKLYDKDLGSAMGDTVVGWLDAATSL

SEQ ID NO: 2624 - protein, 28 aa, Artificial Sequence
  Description of Artificial Sequence: Synthetic peptide
  N-term acetylated
DDPKLYDKDLGSAMGDTVVGWLDAATSL

SEQ ID NO: 2625 - protein, 28 aa, Artificial Sequence
  Description of Artificial Sequence: Synthetic peptide
  N-term acetylated
  C-term amidated
DDPKLYDKDLGSAMGDTVVGWMDAAWSL

SEQ ID NO: 2626 - protein, 28 aa, Artificial Sequence
  Description of Artificial Sequence: Synthetic peptide
  N-term acetylated
DDPKLYDKDLGSAMGDTVVGWMDAAWSL

SEQ ID NO: 2627 - protein, 28 aa, Artificial Sequence
  Description of Artificial Sequence: Synthetic peptide
  N-term acetylated
  C-term amidated
DDPKLYDKDLGSAMGDTVVGWMDAATSL

SEQ ID NO: 2628 - protein, 28 aa, Artificial Sequence
  Description of Artificial Sequence: Synthetic peptide
  N-term acetylated
DDPKLYDKDLGSAMGDTVVGWMDAATSL

SEQ ID NO: 2629 - protein, 28 aa, Artificial Sequence
  Description of Artificial Sequence: Synthetic peptide
  N-term acetylated
  C-term amidated
DDPKLYDKDLGSAMGDTVVGQVDAAWSL

SEQ ID NO: 2630 - protein, 28 aa, Artificial Sequence
  Description of Artificial Sequence: Synthetic peptide
  N-term acetylated
DDPKLYDKDLGSAMGDTVVGQVDAAWSL

SEQ ID NO: 2631 - protein, 28 aa, Artificial Sequence
  Description of Artificial Sequence: Synthetic peptide
  N-term acetylated
  C-term amidated
DDPKLYDKDLGSAMGDTVVGQVDAATSL

SEQ ID NO: 2632 - protein, 28 aa, Artificial Sequence
  Description of Artificial Sequence: Synthetic peptide
  N-term acetylated
DDPKLYDKDLGSAMGDTVVGQVDAATSL

SEQ ID NO: 2633 - protein, 28 aa, Artificial Sequence
  Description of Artificial Sequence: Synthetic peptide
  N-term acetylated
  C-term amidated
DDPKLYDKDLGSAMGDTVVGQLDAAWSL

SEQ ID NO: 2634 - protein, 28 aa, Artificial Sequence
  Description of Artificial Sequence: Synthetic peptide
  N-term acetylated
DDPKLYDKDLGSAMGDTVVGQLDAAWSL

SEQ ID NO: 2635 - protein, 28 aa, Artificial Sequence
  Description of Artificial Sequence: Synthetic peptide
  N-term acetylated
  C-term amidated
DDPKLYDKDLGSAMGDTVVGQLDAATSL

SEQ ID NO: 2636 - protein, 28 aa, Artificial Sequence
  Description of Artificial Sequence: Synthetic peptide
  N-term acetylated
DDPKLYDKDLGSAMGDTVVGQLDAATSL

SEQ ID NO: 2637 - protein, 28 aa, Artificial Sequence
  Description of Artificial Sequence: Synthetic peptide
  N-term acetylated
  C-term amidated
DDPKLYDKDLGSAMGDTVVGQMDAAWSL

SEQ ID NO: 2638 - protein, 28 aa, Artificial Sequence
  Description of Artificial Sequence: Synthetic peptide
  N-term acetylated
DDPKLYDKDLGSAMGDTVVGQMDAAWSL

SEQ ID NO: 2639 - protein, 28 aa, Artificial Sequence
  Description of Artificial Sequence: Synthetic peptide
  N-term acetylated
  C-term amidated
DDPKLYDKDLGSAMGDTVVGQMDAATSL

SEQ ID NO: 2640 - protein, 28 aa, Artificial Sequence
  Description of Artificial Sequence: Synthetic peptide
  N-term acetylated
DDPKLYDKDLGSAMGDTVVGQMDAATSL

SEQ ID NO: 2641 - protein, 28 aa, Artificial Sequence
  Description of Artificial Sequence: Synthetic peptide
  C-term amidated
DDPKLYDKDLGSAVWDWVVAWVDAAWSL

SEQ ID NO: 2642 - protein, 28 aa, Artificial Sequence
  Description of Artificial Sequence: Synthetic peptide
DDPKLYDKDLGSAVWDWVVAWVDAAWSL

SEQ ID NO: 2643 - protein, 28 aa, Artificial Sequence
  Description of Artificial Sequence: Synthetic peptide
  C-term amidated
DDPKLYDKDLGSAVWDWVVAWVDAATSL

SEQ ID NO: 2644 - protein, 28 aa, Artificial Sequence
  Description of Artificial Sequence: Synthetic peptide
DDPKLYDKDLGSAVWDWVVAWVDAATSL

SEQ ID NO: 2645 - protein, 28 aa, Artificial Sequence
  Description of Artificial Sequence: Synthetic peptide
  C-term amidated
DDPKLYDKDLGSAVWDWVVAWLDAAWSL

SEQ ID NO: 2646 - protein, 28 aa, Artificial Sequence
  Description of Artificial Sequence: Synthetic peptide
DDPKLYDKDLGSAVWDWVVAWLDAAWSL

SEQ ID NO: 2647 - protein, 28 aa, Artificial Sequence
  Description of Artificial Sequence: Synthetic peptide
  C-term amidated
DDPKLYDKDLGSAVWDWVVAWLDAATSL

SEQ ID NO: 2648 - protein, 28 aa, Artificial Sequence
  Description of Artificial Sequence: Synthetic peptide
DDPKLYDKDLGSAVWDWVVAWLDAATSL

SEQ ID NO: 2649 - protein, 28 aa, Artificial Sequence
  Description of Artificial Sequence: Synthetic peptide
  C-term amidated
DDPKLYDKDLGSAVWDWVVAWMDAAWSL

SEQ ID NO: 2650 - protein, 28 aa, Artificial Sequence
  Description of Artificial Sequence: Synthetic peptide
DDPKLYDKDLGSAVWDWVVAWMDAAWSL

SEQ ID NO: 2651 - protein, 28 aa, Artificial Sequence
  Description of Artificial Sequence: Synthetic peptide
  C-term amidated
DDPKLYDKDLGSAVWDWVVAWMDAATSL

SEQ ID NO: 2652 - protein, 28 aa, Artificial Sequence
  Description of Artificial Sequence: Synthetic peptide
DDPKLYDKDLGSAVWDWVVAWMDAATSL

SEQ ID NO: 2653 - protein, 28 aa, Artificial Sequence
  Description of Artificial Sequence: Synthetic peptide
  C-term amidated
DDPKLYDKDLGSAVWDWVVAQVDAAWSL

SEQ ID NO: 2654 - protein, 28 aa, Artificial Sequence
  Description of Artificial Sequence: Synthetic peptide
DDPKLYDKDLGSAVWDWVVAQVDAAWSL

SEQ ID NO: 2655 - protein, 28 aa, Artificial Sequence
  Description of Artificial Sequence: Synthetic peptide
  C-term amidated
DDPKLYDKDLGSAVWDWVVAQVDAATSL

SEQ ID NO: 2656 - protein, 28 aa, Artificial Sequence
  Description of Artificial Sequence: Synthetic peptide
DDPKLYDKDLGSAVWDWVVAQVDAATSL

SEQ ID NO: 2657 - protein, 28 aa, Artificial Sequence
  Description of Artificial Sequence: Synthetic peptide
  C-term amidated
DDPKLYDKDLGSAVWDWVVAQLDAAWSL

SEQ ID NO: 2658 - protein, 28 aa, Artificial Sequence
  Description of Artificial Sequence: Synthetic peptide
DDPKLYDKDLGSAVWDWVVAQLDAAWSL

SEQ ID NO: 2659 - protein, 28 aa, Artificial Sequence
  Description of Artificial Sequence: Synthetic peptide
  C-term amidated
DDPKLYDKDLGSAVWDWVVAQLDAATSL

SEQ ID NO: 2660 - protein, 28 aa, Artificial Sequence
  Description of Artificial Sequence: Synthetic peptide
DDPKLYDKDLGSAVWDWVVAQLDAATSL

SEQ ID NO: 2661 - protein, 28 aa, Artificial Sequence
  Description of Artificial Sequence: Synthetic peptide
  C-term amidated
DDPKLYDKDLGSAVWDWVVAQMDAAWSL

SEQ ID NO: 2662 - protein, 28 aa, Artificial Sequence
  Description of Artificial Sequence: Synthetic peptide
DDPKLYDKDLGSAVWDWVVAQMDAAWSL

SEQ ID NO: 2663 - protein, 28 aa, Artificial Sequence
  Description of Artificial Sequence: Synthetic peptide
  C-term amidated
DDPKLYDKDLGSAVWDWVVAQMDAATSL

SEQ ID NO: 2664 - protein, 28 aa, Artificial Sequence
  Description of Artificial Sequence: Synthetic peptide
DDPKLYDKDLGSAVWDWVVAQMDAATSL

SEQ ID NO: 2665 - protein, 28 aa, Artificial Sequence
  Description of Artificial Sequence: Synthetic peptide
  C-term amidated
DDPKLYDKDLGSAVWDWVVGWVDAAWSL

SEQ ID NO: 2666 - protein, 28 aa, Artificial Sequence
  Description of Artificial Sequence: Synthetic peptide
DDPKLYDKDLGSAVWDWVVGWVDAAWSL

SEQ ID NO: 2667 - protein, 28 aa, Artificial Sequence
  Description of Artificial Sequence: Synthetic peptide
  C-term amidated
DDPKLYDKDLGSAVWDWVVGWVDAATSL

SEQ ID NO: 2668 - protein, 28 aa, Artificial Sequence
  Description of Artificial Sequence: Synthetic peptide
DDPKLYDKDLGSAVWDWVVGWVDAATSL

SEQ ID NO: 2669 - protein, 28 aa, Artificial Sequence
  Description of Artificial Sequence: Synthetic peptide
  C-term amidated
DDPKLYDKDLGSAVWDWVVGWLDAAWSL

SEQ ID NO: 2670 - protein, 28 aa, Artificial Sequence
  Description of Artificial Sequence: Synthetic peptide
DDPKLYDKDLGSAVWDWVVGWLDAAWSL

SEQ ID NO: 2671 - protein, 28 aa, Artificial Sequence
  Description of Artificial Sequence: Synthetic peptide
  C-term amidated
DDPKLYDKDLGSAVWDWVVGWLDAATSL

SEQ ID NO: 2672 - protein, 28 aa, Artificial Sequence
  Description of Artificial Sequence: Synthetic peptide
DDPKLYDKDLGSAVWDWVVGWLDAATSL

SEQ ID NO: 2673 - protein, 28 aa, Artificial Sequence
  Description of Artificial Sequence: Synthetic peptide
  C-term amidated
DDPKLYDKDLGSAVWDWVVGWMDAAWSL

SEQ ID NO: 2674 - protein, 28 aa, Artificial Sequence
  Description of Artificial Sequence: Synthetic peptide
DDPKLYDKDLGSAVWDWVVGWMDAAWSL

SEQ ID NO: 2675 - protein, 28 aa, Artificial Sequence
  Description of Artificial Sequence: Synthetic peptide
  C-term amidated
DDPKLYDKDLGSAVWDWVVGWMDAATSL

SEQ ID NO: 2676 - protein, 28 aa, Artificial Sequence
  Description of Artificial Sequence: Synthetic peptide
DDPKLYDKDLGSAVWDWVVGWMDAATSL

SEQ ID NO: 2677 - protein, 28 aa, Artificial Sequence
  Description of Artificial Sequence: Synthetic peptide
  C-term amidated
DDPKLYDKDLGSAVWDWVVGQVDAAWSL

SEQ ID NO: 2678 - protein, 28 aa, Artificial Sequence
  Description of Artificial Sequence: Synthetic peptide
DDPKLYDKDLGSAVWDWVVGQVDAAWSL

SEQ ID NO: 2679 - protein, 28 aa, Artificial Sequence
  Description of Artificial Sequence: Synthetic peptide
  C-term amidated
DDPKLYDKDLGSAVWDWVVGQVDAATSL

SEQ ID NO: 2680 - protein, 28 aa, Artificial Sequence
  Description of Artificial Sequence: Synthetic peptide
DDPKLYDKDLGSAVWDWVVGQVDAATSL

SEQ ID NO: 2681 - protein, 28 aa, Artificial Sequence
  Description of Artificial Sequence: Synthetic peptide
  C-term amidated
DDPKLYDKDLGSAVWDWVVGQLDAAWSL

SEQ ID NO: 2682 - protein, 28 aa, Artificial Sequence
  Description of Artificial Sequence: Synthetic peptide
DDPKLYDKDLGSAVWDWVVGQLDAAWSL

SEQ ID NO: 2683 - protein, 28 aa, Artificial Sequence
  Description of Artificial Sequence: Synthetic peptide
  C-term amidated
DDPKLYDKDLGSAVWDWVVGQLDAATSL

SEQ ID NO: 2684 - protein, 28 aa, Artificial Sequence
  Description of Artificial Sequence: Synthetic peptide
DDPKLYDKDLGSAVWDWVVGQLDAATSL

SEQ ID NO: 2685 - protein, 28 aa, Artificial Sequence
  Description of Artificial Sequence: Synthetic peptide
  C-term amidated
DDPKLYDKDLGSAVWDWVVGQMDAAWSL

SEQ ID NO: 2686 - protein, 28 aa, Artificial Sequence
  Description of Artificial Sequence: Synthetic peptide
DDPKLYDKDLGSAVWDWVVGQMDAAWSL

SEQ ID NO: 2687 - protein, 28 aa, Artificial Sequence
  Description of Artificial Sequence: Synthetic peptide
  C-term amidated
DDPKLYDKDLGSAVWDWVVGQMDAATSL

SEQ ID NO: 2688 - protein, 28 aa, Artificial Sequence
  Description of Artificial Sequence: Synthetic peptide
DDPKLYDKDLGSAVWDWVVGQMDAATSL

SEQ ID NO: 2689 - protein, 28 aa, Artificial Sequence
  Description of Artificial Sequence: Synthetic peptide
  C-term amidated
DDPKLYDKDLGSAVWDTVVAWVDAAWSL

SEQ ID NO: 2690 - protein, 28 aa, Artificial Sequence
  Description of Artificial Sequence: Synthetic peptide
DDPKLYDKDLGSAVWDTVVAWVDAAWSL

SEQ ID NO: 2691 - protein, 28 aa, Artificial Sequence
  Description of Artificial Sequence: Synthetic peptide
  C-term amidated
DDPKLYDKDLGSAVWDTVVAWVDAATSL

SEQ ID NO: 2692 - protein, 28 aa, Artificial Sequence
  Description of Artificial Sequence: Synthetic peptide
DDPKLYDKDLGSAVWDTVVAWVDAATSL

SEQ ID NO: 2693 - protein, 28 aa, Artificial Sequence
  Description of Artificial Sequence: Synthetic peptide
  C-term amidated
DDPKLYDKDLGSAVWDTVVAWLDAAWSL

SEQ ID NO: 2694 - protein, 28 aa, Artificial Sequence
  Description of Artificial Sequence: Synthetic peptide
DDPKLYDKDLGSAVWDTVVAWLDAAWSL

SEQ ID NO: 2695 - protein, 28 aa, Artificial Sequence
  Description of Artificial Sequence: Synthetic peptide
  C-term amidated
DDPKLYDKDLGSAVWDTVVAWLDAATSL

SEQ ID NO: 2696 - protein, 28 aa, Artificial Sequence
  Description of Artificial Sequence: Synthetic peptide
DDPKLYDKDLGSAVWDTVVAWLDAATSL

SEQ ID NO: 2697 - protein, 28 aa, Artificial Sequence
  Description of Artificial Sequence: Synthetic peptide
  C-term amidated
DDPKLYDKDLGSAVWDTVVAWMDAAWSL

SEQ ID NO: 2698 - protein, 28 aa, Artificial Sequence
  Description of Artificial Sequence: Synthetic peptide
DDPKLYDKDLGSAVWDTVVAWMDAAWSL

SEQ ID NO: 2699 - protein, 28 aa, Artificial Sequence
  Description of Artificial Sequence: Synthetic peptide
  C-term amidated
DDPKLYDKDLGSAVWDTVVAWMDAATSL

SEQ ID NO: 2700 - protein, 28 aa, Artificial Sequence
  Description of Artificial Sequence: Synthetic peptide
DDPKLYDKDLGSAVWDTVVAWMDAATSL

SEQ ID NO: 2701 - protein, 28 aa, Artificial Sequence
  Description of Artificial Sequence: Synthetic peptide
  C-term amidated
DDPKLYDKDLGSAVWDTVVAQVDAAWSL

SEQ ID NO: 2702 - protein, 28 aa, Artificial Sequence
  Description of Artificial Sequence: Synthetic peptide
DDPKLYDKDLGSAVWDTVVAQVDAAWSL

SEQ ID NO: 2703 - protein, 28 aa, Artificial Sequence
  Description of Artificial Sequence: Synthetic peptide
  C-term amidated
DDPKLYDKDLGSAVWDTVVAQVDAATSL

SEQ ID NO: 2704 - protein, 28 aa, Artificial Sequence
  Description of Artificial Sequence: Synthetic peptide
DDPKLYDKDLGSAVWDTVVAQVDAATSL

SEQ ID NO: 2705 - protein, 28 aa, Artificial Sequence
  Description of Artificial Sequence: Synthetic peptide
  C-term amidated
DDPKLYDKDLGSAVWDTVVAQLDAAWSL

SEQ ID NO: 2706 - protein, 28 aa, Artificial Sequence
  Description of Artificial Sequence: Synthetic peptide
DDPKLYDKDLGSAVWDTVVAQLDAAWSL

SEQ ID NO: 2707 - protein, 28 aa, Artificial Sequence
  Description of Artificial Sequence: Synthetic peptide
  C-term amidated
DDPKLYDKDLGSAVWDTVVAQLDAATSL

SEQ ID NO: 2708 - protein, 28 aa, Artificial Sequence
  Description of Artificial Sequence: Synthetic peptide
DDPKLYDKDLGSAVWDTVVAQLDAATSL

SEQ ID NO: 2709 - protein, 28 aa, Artificial Sequence
  Description of Artificial Sequence: Synthetic peptide
  C-term amidated
DDPKLYDKDLGSAVWDTVVAQMDAAWSL

SEQ ID NO: 2710 - protein, 28 aa, Artificial Sequence
  Description of Artificial Sequence: Synthetic peptide
DDPKLYDKDLGSAVWDTVVAQMDAAWSL

SEQ ID NO: 2711 - protein, 28 aa, Artificial Sequence
  Description of Artificial Sequence: Synthetic peptide
  C-term amidated
DDPKLYDKDLGSAVWDTVVAQMDAATSL

SEQ ID NO: 2712 - protein, 28 aa, Artificial Sequence
  Description of Artificial Sequence: Synthetic peptide
DDPKLYDKDLGSAVWDTVVAQMDAATSL

SEQ ID NO: 2713 - protein, 28 aa, Artificial Sequence
  Description of Artificial Sequence: Synthetic peptide
  C-term amidated
DDPKLYDKDLGSAVWDTVVGWVDAAWSL

SEQ ID NO: 2714 - protein, 28 aa, Artificial Sequence
  Description of Artificial Sequence: Synthetic peptide
DDPKLYDKDLGSAVWDTVVGWVDAAWSL

SEQ ID NO: 2715 - protein, 28 aa, Artificial Sequence
  Description of Artificial Sequence: Synthetic peptide
  C-term amidated
DDPKLYDKDLGSAVWDTVVGWVDAATSL

SEQ ID NO: 2716 - protein, 28 aa, Artificial Sequence
  Description of Artificial Sequence: Synthetic peptide
DDPKLYDKDLGSAVWDTVVGWVDAATSL

SEQ ID NO: 2717 - protein, 28 aa, Artificial Sequence
  Description of Artificial Sequence: Synthetic peptide
  C-term amidated
DDPKLYDKDLGSAVWDTVVGWLDAAWSL

SEQ ID NO: 2718 - protein, 28 aa, Artificial Sequence
  Description of Artificial Sequence: Synthetic peptide
DDPKLYDKDLGSAVWDTVVGWLDAAWSL

SEQ ID NO: 2719 - protein, 28 aa, Artificial Sequence
  Description of Artificial Sequence: Synthetic peptide
  C-term amidated
DDPKLYDKDLGSAVWDTVVGWLDAATSL

SEQ ID NO: 2720 - protein, 28 aa, Artificial Sequence
  Description of Artificial Sequence: Synthetic peptide
DDPKLYDKDLGSAVWDTVVGWLDAATSL

SEQ ID NO: 2721 - protein, 28 aa, Artificial Sequence
  Description of Artificial Sequence: Synthetic peptide
  C-term amidated
DDPKLYDKDLGSAVWDTVVGWMDAAWSL

SEQ ID NO: 2722 - protein, 28 aa, Artificial Sequence
  Description of Artificial Sequence: Synthetic peptide
DDPKLYDKDLGSAVWDTVVGWMDAAWSL

SEQ ID NO: 2723 - protein, 28 aa, Artificial Sequence
  Description of Artificial Sequence: Synthetic peptide
  C-term amidated
DDPKLYDKDLGSAVWDTVVGWMDAATSL

SEQ ID NO: 2724 - protein, 28 aa, Artificial Sequence
  Description of Artificial Sequence: Synthetic peptide
DDPKLYDKDLGSAVWDTVVGWMDAATSL

SEQ ID NO: 2725 - protein, 28 aa, Artificial Sequence
  Description of Artificial Sequence: Synthetic peptide
  C-term amidated
DDPKLYDKDLGSAVWDTVVGQVDAAWSL

SEQ ID NO: 2726 - protein, 28 aa, Artificial Sequence
  Description of Artificial Sequence: Synthetic peptide
DDPKLYDKDLGSAVWDTVVGQVDAAWSL

SEQ ID NO: 2727 - protein, 28 aa, Artificial Sequence
  Description of Artificial Sequence: Synthetic peptide
  C-term amidated
DDPKLYDKDLGSAVWDTVVGQVDAATSL

SEQ ID NO: 2728 - protein, 28 aa, Artificial Sequence
  Description of Artificial Sequence: Synthetic peptide
DDPKLYDKDLGSAVWDTVVGQVDAATSL

SEQ ID NO: 2729 - protein, 28 aa, Artificial Sequence
  Description of Artificial Sequence: Synthetic peptide
  C-term amidated
DDPKLYDKDLGSAVWDTVVGQLDAAWSL

SEQ ID NO: 2730 - protein, 28 aa, Artificial Sequence
  Description of Artificial Sequence: Synthetic peptide
DDPKLYDKDLGSAVWDTVVGQLDAAWSL

SEQ ID NO: 2731 - protein, 28 aa, Artificial Sequence
  Description of Artificial Sequence: Synthetic peptide
  C-term amidated
DDPKLYDKDLGSAVWDTVVGQLDAATSL

SEQ ID NO: 2732 - protein, 28 aa, Artificial Sequence
  Description of Artificial Sequence: Synthetic peptide
DDPKLYDKDLGSAVWDTVVGQLDAATSL

SEQ ID NO: 2733 - protein, 28 aa, Artificial Sequence
  Description of Artificial Sequence: Synthetic peptide
  C-term amidated
DDPKLYDKDLGSAVWDTVVGQMDAAWSL

SEQ ID NO: 2734 - protein, 28 aa, Artificial Sequence
  Description of Artificial Sequence: Synthetic peptide
DDPKLYDKDLGSAVWDTVVGQMDAAWSL

SEQ ID NO: 2735 - protein, 28 aa, Artificial Sequence
  Description of Artificial Sequence: Synthetic peptide
  C-term amidated
DDPKLYDKDLGSAVWDTVVGQMDAATSL

SEQ ID NO: 2736 - protein, 28 aa, Artificial Sequence
  Description of Artificial Sequence: Synthetic peptide
DDPKLYDKDLGSAVWDTVVGQMDAATSL

SEQ ID NO: 2737 - protein, 28 aa, Artificial Sequence
  Description of Artificial Sequence: Synthetic peptide
  C-term amidated
DDPKLYDKDLGSAVTDWVVAWVDAAWSL

SEQ ID NO: 2738 - protein, 28 aa, Artificial Sequence
  Description of Artificial Sequence: Synthetic peptide
DDPKLYDKDLGSAVTDWVVAWVDAAWSL

SEQ ID NO: 2739 - protein, 28 aa, Artificial Sequence
  Description of Artificial Sequence: Synthetic peptide
  C-term amidated
DDPKLYDKDLGSAVTDWVVAWVDAATSL

SEQ ID NO: 2740 - protein, 28 aa, Artificial Sequence
  Description of Artificial Sequence: Synthetic peptide
DDPKLYDKDLGSAVTDWVVAWVDAATSL

SEQ ID NO: 2741 - protein, 28 aa, Artificial Sequence
  Description of Artificial Sequence: Synthetic peptide
  C-term amidated
DDPKLYDKDLGSAVTDWVVAWLDAAWSL

SEQ ID NO: 2742 - protein, 28 aa, Artificial Sequence
  Description of Artificial Sequence: Synthetic peptide
DDPKLYDKDLGSAVTDWVVAWLDAAWSL

SEQ ID NO: 2743 - protein, 28 aa, Artificial Sequence
  Description of Artificial Sequence: Synthetic peptide
  C-term amidated
DDPKLYDKDLGSAVTDWVVAWLDAATSL

SEQ ID NO: 2744 - protein, 28 aa, Artificial Sequence
  Description of Artificial Sequence: Synthetic peptide
DDPKLYDKDLGSAVTDWVVAWLDAATSL

SEQ ID NO: 2745 - protein, 28 aa, Artificial Sequence
  Description of Artificial Sequence: Synthetic peptide
  C-term amidated
DDPKLYDKDLGSAVTDWVVAWMDAAWSL

SEQ ID NO: 2746 - protein, 28 aa, Artificial Sequence
  Description of Artificial Sequence: Synthetic peptide
DDPKLYDKDLGSAVTDWVVAWMDAAWSL

SEQ ID NO: 2747 - protein, 28 aa, Artificial Sequence
  Description of Artificial Sequence: Synthetic peptide
  C-term amidated
DDPKLYDKDLGSAVTDWVVAWMDAATSL

SEQ ID NO: 2748 - protein, 28 aa, Artificial Sequence
  Description of Artificial Sequence: Synthetic peptide
DDPKLYDKDLGSAVTDWVVAWMDAATSL

SEQ ID NO: 2749 - protein, 28 aa, Artificial Sequence
  Description of Artificial Sequence: Synthetic peptide
  C-term amidated
DDPKLYDKDLGSAVTDWVVAQVDAAWSL

SEQ ID NO: 2750 - protein, 28 aa, Artificial Sequence
  Description of Artificial Sequence: Synthetic peptide
DDPKLYDKDLGSAVTDWVVAQVDAAWSL

SEQ ID NO: 2751 - protein, 28 aa, Artificial Sequence
  Description of Artificial Sequence: Synthetic peptide
  C-term amidated
DDPKLYDKDLGSAVTDWVVAQVDAATSL

SEQ ID NO: 2752 - protein, 28 aa, Artificial Sequence
  Description of Artificial Sequence: Synthetic peptide
DDPKLYDKDLGSAVTDWVVAQVDAATSL

SEQ ID NO: 2753 - protein, 28 aa, Artificial Sequence
  Description of Artificial Sequence: Synthetic peptide
  C-term amidated
DDPKLYDKDLGSAVTDWVVAQLDAAWSL

SEQ ID NO: 2754 - protein, 28 aa, Artificial Sequence
  Description of Artificial Sequence: Synthetic peptide
DDPKLYDKDLGSAVTDWVVAQLDAAWSL

SEQ ID NO: 2755 - protein, 28 aa, Artificial Sequence
  Description of Artificial Sequence: Synthetic peptide
  C-term amidated
DDPKLYDKDLGSAVTDWVVAQLDAATSL

SEQ ID NO: 2756 - protein, 28 aa, Artificial Sequence
  Description of Artificial Sequence: Synthetic peptide
DDPKLYDKDLGSAVTDWVVAQLDAATSL

SEQ ID NO: 2757 - protein, 28 aa, Artificial Sequence
  Description of Artificial Sequence: Synthetic peptide
  C-term amidated
DDPKLYDKDLGSAVTDWVVAQMDAAWSL

SEQ ID NO: 2758 - protein, 28 aa, Artificial Sequence
  Description of Artificial Sequence: Synthetic peptide
DDPKLYDKDLGSAVTDWVVAQMDAAWSL

SEQ ID NO: 2759 - protein, 28 aa, Artificial Sequence
  Description of Artificial Sequence: Synthetic peptide
  C-term amidated
DDPKLYDKDLGSAVTDWVVAQMDAATSL

SEQ ID NO: 2760 - protein, 28 aa, Artificial Sequence
  Description of Artificial Sequence: Synthetic peptide
DDPKLYDKDLGSAVTDWVVAQMDAATSL

SEQ ID NO: 2761 - protein, 28 aa, Artificial Sequence
  Description of Artificial Sequence: Synthetic peptide
  C-term amidated
DDPKLYDKDLGSAVTDWVVGWVDAAWSL

SEQ ID NO: 2762 - protein, 28 aa, Artificial Sequence
  Description of Artificial Sequence: Synthetic peptide
DDPKLYDKDLGSAVTDWVVGWVDAAWSL

SEQ ID NO: 2763 - protein, 28 aa, Artificial Sequence
  Description of Artificial Sequence: Synthetic peptide
  C-term amidated
DDPKLYDKDLGSAVTDWVVGWVDAATSL

SEQ ID NO: 2764 - protein, 28 aa, Artificial Sequence
  Description of Artificial Sequence: Synthetic peptide
DDPKLYDKDLGSAVTDWVVGWVDAATSL

SEQ ID NO: 2765 - protein, 28 aa, Artificial Sequence
  Description of Artificial Sequence: Synthetic peptide
  C-term amidated
DDPKLYDKDLGSAVTDWVVGWLDAAWSL

SEQ ID NO: 2766 - protein, 28 aa, Artificial Sequence
  Description of Artificial Sequence: Synthetic peptide
DDPKLYDKDLGSAVTDWVVGWLDAAWSL

SEQ ID NO: 2767 - protein, 28 aa, Artificial Sequence
  Description of Artificial Sequence: Synthetic peptide
  C-term amidated
DDPKLYDKDLGSAVTDWVVGWLDAATSL

SEQ ID NO: 2768 - protein, 28 aa, Artificial Sequence
  Description of Artificial Sequence: Synthetic peptide
DDPKLYDKDLGSAVTDWVVGWLDAATSL

SEQ ID NO: 2769 - protein, 28 aa, Artificial Sequence
  Description of Artificial Sequence: Synthetic peptide
  C-term amidated
DDPKLYDKDLGSAVTDWVVGWMDAAWSL

SEQ ID NO: 2770 - protein, 28 aa, Artificial Sequence
  Description of Artificial Sequence: Synthetic peptide
DDPKLYDKDLGSAVTDWVVGWMDAAWSL

SEQ ID NO: 2771 - protein, 28 aa, Artificial Sequence
  Description of Artificial Sequence: Synthetic peptide
  C-term amidated
DDPKLYDKDLGSAVTDWVVGWMDAATSL

SEQ ID NO: 2772 - protein, 28 aa, Artificial Sequence
  Description of Artificial Sequence: Synthetic peptide
DDPKLYDKDLGSAVTDWVVGWMDAATSL

SEQ ID NO: 2773 - protein, 28 aa, Artificial Sequence
  Description of Artificial Sequence: Synthetic peptide
  C-term amidated
DDPKLYDKDLGSAVTDWVVGQVDAAWSL

SEQ ID NO: 2774 - protein, 28 aa, Artificial Sequence
  Description of Artificial Sequence: Synthetic peptide
DDPKLYDKDLGSAVTDWVVGQVDAAWSL

SEQ ID NO: 2775 - protein, 28 aa, Artificial Sequence
  Description of Artificial Sequence: Synthetic peptide
  C-term amidated
DDPKLYDKDLGSAVTDWVVGQVDAATSL

SEQ ID NO: 2776 - protein, 28 aa, Artificial Sequence
  Description of Artificial Sequence: Synthetic peptide
DDPKLYDKDLGSAVTDWVVGQVDAATSL

SEQ ID NO: 2777 - protein, 28 aa, Artificial Sequence
  Description of Artificial Sequence: Synthetic peptide
  C-term amidated
DDPKLYDKDLGSAVTDWVVGQLDAAWSL

SEQ ID NO: 2778 - protein, 28 aa, Artificial Sequence
  Description of Artificial Sequence: Synthetic peptide
DDPKLYDKDLGSAVTDWVVGQLDAAWSL

SEQ ID NO: 2779 - protein, 28 aa, Artificial Sequence
  Description of Artificial Sequence: Synthetic peptide
  C-term amidated
DDPKLYDKDLGSAVTDWVVGQLDAATSL

SEQ ID NO: 2780 - protein, 28 aa, Artificial Sequence
  Description of Artificial Sequence: Synthetic peptide
DDPKLYDKDLGSAVTDWVVGQLDAATSL

SEQ ID NO: 2781 - protein, 28 aa, Artificial Sequence
  Description of Artificial Sequence: Synthetic peptide
  C-term amidated
DDPKLYDKDLGSAVTDWVVGQMDAAWSL

SEQ ID NO: 2782 - protein, 28 aa, Artificial Sequence
  Description of Artificial Sequence: Synthetic peptide
DDPKLYDKDLGSAVTDWVVGQMDAAWSL

SEQ ID NO: 2783 - protein, 28 aa, Artificial Sequence
  Description of Artificial Sequence: Synthetic peptide
  C-term amidated
DDPKLYDKDLGSAVTDWVVGQMDAATSL

SEQ ID NO: 2784 - protein, 28 aa, Artificial Sequence
  Description of Artificial Sequence: Synthetic peptide
DDPKLYDKDLGSAVTDWVVGQMDAATSL

SEQ ID NO: 2785 - protein, 28 aa, Artificial Sequence
  Description of Artificial Sequence: Synthetic peptide
  C-term amidated
DDPKLYDKDLGSAVTDTVVAWVDAAWSL

SEQ ID NO: 2786 - protein, 28 aa, Artificial Sequence
  Description of Artificial Sequence: Synthetic peptide
DDPKLYDKDLGSAVTDTVVAWVDAAWSL

SEQ ID NO: 2787 - protein, 28 aa, Artificial Sequence
  Description of Artificial Sequence: Synthetic peptide
  C-term amidated
DDPKLYDKDLGSAVTDTVVAWVDAATSL

SEQ ID NO: 2788 - protein, 28 aa, Artificial Sequence
  Description of Artificial Sequence: Synthetic peptide
DDPKLYDKDLGSAVTDTVVAWVDAATSL

SEQ ID NO: 2789 - protein, 28 aa, Artificial Sequence
  Description of Artificial Sequence: Synthetic peptide
  C-term amidated
DDPKLYDKDLGSAVTDTVVAWLDAAWSL

SEQ ID NO: 2790 - protein, 28 aa, Artificial Sequence
  Description of Artificial Sequence: Synthetic peptide
DDPKLYDKDLGSAVTDTVVAWLDAAWSL

SEQ ID NO: 2791 - protein, 28 aa, Artificial Sequence
  Description of Artificial Sequence: Synthetic peptide
  C-term amidated
DDPKLYDKDLGSAVTDTVVAWLDAATSL

SEQ ID NO: 2792 - protein, 28 aa, Artificial Sequence
  Description of Artificial Sequence: Synthetic peptide
DDPKLYDKDLGSAVTDTVVAWLDAATSL

SEQ ID NO: 2793 - protein, 28 aa, Artificial Sequence
  Description of Artificial Sequence: Synthetic peptide
  C-term amidated
DDPKLYDKDLGSAVTDTVVAWMDAAWSL

SEQ ID NO: 2794 - protein, 28 aa, Artificial Sequence
  Description of Artificial Sequence: Synthetic peptide
DDPKLYDKDLGSAVTDTVVAWMDAAWSL

SEQ ID NO: 2795 - protein, 28 aa, Artificial Sequence
  Description of Artificial Sequence: Synthetic peptide
  C-term amidated
DDPKLYDKDLGSAVTDTVVAWMDAATSL

SEQ ID NO: 2796 - protein, 28 aa, Artificial Sequence
  Description of Artificial Sequence: Synthetic peptide
DDPKLYDKDLGSAVTDTVVAWMDAATSL

SEQ ID NO: 2797 - protein, 28 aa, Artificial Sequence
  Description of Artificial Sequence: Synthetic peptide
  C-term amidated
DDPKLYDKDLGSAVTDTVVAQVDAAWSL

SEQ ID NO: 2798 - protein, 28 aa, Artificial Sequence
  Description of Artificial Sequence: Synthetic peptide
DDPKLYDKDLGSAVTDTVVAQVDAAWSL

SEQ ID NO: 2799 - protein, 28 aa, Artificial Sequence
  Description of Artificial Sequence: Synthetic peptide
  C-term amidated
DDPKLYDKDLGSAVTDTVVAQVDAATSL

SEQ ID NO: 2800 - protein, 28 aa, Artificial Sequence
  Description of Artificial Sequence: Synthetic peptide
DDPKLYDKDLGSAVTDTVVAQVDAATSL

SEQ ID NO: 2801 - protein, 28 aa, Artificial Sequence
  Description of Artificial Sequence: Synthetic peptide
  C-term amidated
DDPKLYDKDLGSAVTDTVVAQLDAAWSL

SEQ ID NO: 2802 - protein, 28 aa, Artificial Sequence
  Description of Artificial Sequence: Synthetic peptide
DDPKLYDKDLGSAVTDTVVAQLDAAWSL

SEQ ID NO: 2803 - protein, 28 aa, Artificial Sequence
  Description of Artificial Sequence: Synthetic peptide
  C-term amidated
DDPKLYDKDLGSAVTDTVVAQLDAATSL

SEQ ID NO: 2804 - protein, 28 aa, Artificial Sequence
  Description of Artificial Sequence: Synthetic peptide
DDPKLYDKDLGSAVTDTVVAQLDAATSL

SEQ ID NO: 2805 - protein, 28 aa, Artificial Sequence
  Description of Artificial Sequence: Synthetic peptide
  C-term amidated
DDPKLYDKDLGSAVTDTVVAQMDAAWSL

SEQ ID NO: 2806 - protein, 28 aa, Artificial Sequence
  Description of Artificial Sequence: Synthetic peptide
DDPKLYDKDLGSAVTDTVVAQMDAAWSL

SEQ ID NO: 2807 - protein, 28 aa, Artificial Sequence
  Description of Artificial Sequence: Synthetic peptide
  C-term amidated
DDPKLYDKDLGSAVTDTVVAQMDAATSL

SEQ ID NO: 2808 - protein, 28 aa, Artificial Sequence
  Description of Artificial Sequence: Synthetic peptide
DDPKLYDKDLGSAVTDTVVAQMDAATSL

SEQ ID NO: 2809 - protein, 28 aa, Artificial Sequence
  Description of Artificial Sequence: Synthetic peptide
  C-term amidated
DDPKLYDKDLGSAVTDTVVGWVDAAWSL

SEQ ID NO: 2810 - protein, 28 aa, Artificial Sequence
  Description of Artificial Sequence: Synthetic peptide
DDPKLYDKDLGSAVTDTVVGWVDAAWSL

SEQ ID NO: 2811 - protein, 28 aa, Artificial Sequence
  Description of Artificial Sequence: Synthetic peptide
  C-term amidated
DDPKLYDKDLGSAVTDTVVGWVDAATSL

SEQ ID NO: 2812 - protein, 28 aa, Artificial Sequence
  Description of Artificial Sequence: Synthetic peptide
DDPKLYDKDLGSAVTDTVVGWVDAATSL

SEQ ID NO: 2813 - protein, 28 aa, Artificial Sequence
  Description of Artificial Sequence: Synthetic peptide
  C-term amidated
DDPKLYDKDLGSAVTDTVVGWLDAAWSL

SEQ ID NO: 2814 - protein, 28 aa, Artificial Sequence
  Description of Artificial Sequence: Synthetic peptide
DDPKLYDKDLGSAVTDTVVGWLDAAWSL

SEQ ID NO: 2815 - protein, 28 aa, Artificial Sequence
  Description of Artificial Sequence: Synthetic peptide
  C-term amidated
DDPKLYDKDLGSAVTDTVVGWLDAATSL

SEQ ID NO: 2816 - protein, 28 aa, Artificial Sequence
  Description of Artificial Sequence: Synthetic peptide
DDPKLYDKDLGSAVTDTVVGWLDAATSL

SEQ ID NO: 2817 - protein, 28 aa, Artificial Sequence
  Description of Artificial Sequence: Synthetic peptide
  C-term amidated
DDPKLYDKDLGSAVTDTVVGWMDAAWSL

SEQ ID NO: 2818 - protein, 28 aa, Artificial Sequence
  Description of Artificial Sequence: Synthetic peptide
DDPKLYDKDLGSAVTDTVVGWMDAAWSL

SEQ ID NO: 2819 - protein, 28 aa, Artificial Sequence
  Description of Artificial Sequence: Synthetic peptide
  C-term amidated
DDPKLYDKDLGSAVTDTVVGWMDAATSL

SEQ ID NO: 2820 - protein, 28 aa, Artificial Sequence
  Description of Artificial Sequence: Synthetic peptide
DDPKLYDKDLGSAVTDTVVGWMDAATSL

SEQ ID NO: 2821 - protein, 28 aa, Artificial Sequence
  Description of Artificial Sequence: Synthetic peptide
  C-term amidated
DDPKLYDKDLGSAVTDTVVGQVDAAWSL

SEQ ID NO: 2822 - protein, 28 aa, Artificial Sequence
  Description of Artificial Sequence: Synthetic peptide
DDPKLYDKDLGSAVTDTVVGQVDAAWSL

SEQ ID NO: 2823 - protein, 28 aa, Artificial Sequence
  Description of Artificial Sequence: Synthetic peptide
  C-term amidated
DDPKLYDKDLGSAVTDTVVGQVDAATSL

SEQ ID NO: 2824 - protein, 28 aa, Artificial Sequence
  Description of Artificial Sequence: Synthetic peptide
DDPKLYDKDLGSAVTDTVVGQVDAATSL

SEQ ID NO: 2825 - protein, 28 aa, Artificial Sequence
  Description of Artificial Sequence: Synthetic peptide
  C-term amidated
DDPKLYDKDLGSAVTDTVVGQLDAAWSL

SEQ ID NO: 2826 - protein, 28 aa, Artificial Sequence
  Description of Artificial Sequence: Synthetic peptide
DDPKLYDKDLGSAVTDTVVGQLDAAWSL

SEQ ID NO: 2827 - protein, 28 aa, Artificial Sequence
  Description of Artificial Sequence: Synthetic peptide
  C-term amidated
DDPKLYDKDLGSAVTDTVVGQLDAATSL

SEQ ID NO: 2828 - protein, 28 aa, Artificial Sequence
  Description of Artificial Sequence: Synthetic peptide
DDPKLYDKDLGSAVTDTVVGQLDAATSL

SEQ ID NO: 2829 - protein, 28 aa, Artificial Sequence
  Description of Artificial Sequence: Synthetic peptide
  C-term amidated
DDPKLYDKDLGSAVTDTVVGQMDAAWSL

SEQ ID NO: 2830 - protein, 28 aa, Artificial Sequence
  Description of Artificial Sequence: Synthetic peptide
DDPKLYDKDLGSAVTDTVVGQMDAAWSL

SEQ ID NO: 2831 - protein, 28 aa, Artificial Sequence
  Description of Artificial Sequence: Synthetic peptide
  C-term amidated
DDPKLYDKDLGSAVTDTVVGQMDAATSL

SEQ ID NO: 2832 - protein, 28 aa, Artificial Sequence
  Description of Artificial Sequence: Synthetic peptide
DDPKLYDKDLGSAVTDTVVGQMDAATSL

SEQ ID NO: 2833 - protein, 28 aa, Artificial Sequence
  Description of Artificial Sequence: Synthetic peptide
  C-term amidated
DDPKLYDKDLGSAVGDWVVAWVDAAWSL

SEQ ID NO: 2834 - protein, 28 aa, Artificial Sequence
  Description of Artificial Sequence: Synthetic peptide
DDPKLYDKDLGSAVGDWVVAWVDAAWSL

SEQ ID NO: 2835 - protein, 28 aa, Artificial Sequence
  Description of Artificial Sequence: Synthetic peptide
  C-term amidated
DDPKLYDKDLGSAVGDWVVAWVDAATSL

SEQ ID NO: 2836 - protein, 28 aa, Artificial Sequence
  Description of Artificial Sequence: Synthetic peptide
DDPKLYDKDLGSAVGDWVVAWVDAATSL

SEQ ID NO: 2837 - protein, 28 aa, Artificial Sequence
  Description of Artificial Sequence: Synthetic peptide
  C-term amidated
DDPKLYDKDLGSAVGDWVVAWLDAAWSL

SEQ ID NO: 2838 - protein, 28 aa, Artificial Sequence
  Description of Artificial Sequence: Synthetic peptide
DDPKLYDKDLGSAVGDWVVAWLDAAWSL

SEQ ID NO: 2839 - protein, 28 aa, Artificial Sequence
  Description of Artificial Sequence: Synthetic peptide
  C-term amidated
DDPKLYDKDLGSAVGDWVVAWLDAATSL

SEQ ID NO: 2840 - protein, 28 aa, Artificial Sequence
  Description of Artificial Sequence: Synthetic peptide
DDPKLYDKDLGSAVGDWVVAWLDAATSL

SEQ ID NO: 2841 - protein, 28 aa, Artificial Sequence
  Description of Artificial Sequence: Synthetic peptide
  C-term amidated
DDPKLYDKDLGSAVGDWVVAWMDAAWSL

SEQ ID NO: 2842 - protein, 28 aa, Artificial Sequence
  Description of Artificial Sequence: Synthetic peptide
DDPKLYDKDLGSAVGDWVVAWMDAAWSL

SEQ ID NO: 2843 - protein, 28 aa, Artificial Sequence
  Description of Artificial Sequence: Synthetic peptide
  C-term amidated
DDPKLYDKDLGSAVGDWVVAWMDAATSL

SEQ ID NO: 2844 - protein, 28 aa, Artificial Sequence
  Description of Artificial Sequence: Synthetic peptide
DDPKLYDKDLGSAVGDWVVAWMDAATSL

SEQ ID NO: 2845 - protein, 28 aa, Artificial Sequence
  Description of Artificial Sequence: Synthetic peptide
  C-term amidated
DDPKLYDKDLGSAVGDWVVAQVDAAWSL

SEQ ID NO: 2846 - protein, 28 aa, Artificial Sequence
  Description of Artificial Sequence: Synthetic peptide
DDPKLYDKDLGSAVGDWVVAQVDAAWSL

SEQ ID NO: 2847 - protein, 28 aa, Artificial Sequence
  Description of Artificial Sequence: Synthetic peptide
  C-term amidated
DDPKLYDKDLGSAVGDWVVAQVDAATSL

SEQ ID NO: 2848 - protein, 28 aa, Artificial Sequence
  Description of Artificial Sequence: Synthetic peptide
DDPKLYDKDLGSAVGDWVVAQVDAATSL

SEQ ID NO: 2849 - protein, 28 aa, Artificial Sequence
  Description of Artificial Sequence: Synthetic peptide
  C-term amidated
DDPKLYDKDLGSAVGDWVVAQLDAAWSL

SEQ ID NO: 2850 - protein, 28 aa, Artificial Sequence
  Description of Artificial Sequence: Synthetic peptide
DDPKLYDKDLGSAVGDWVVAQLDAAWSL

SEQ ID NO: 2851 - protein, 28 aa, Artificial Sequence
  Description of Artificial Sequence: Synthetic peptide
  C-term amidated
DDPKLYDKDLGSAVGDWVVAQLDAATSL

SEQ ID NO: 2852 - protein, 28 aa, Artificial Sequence
  Description of Artificial Sequence: Synthetic peptide
DDPKLYDKDLGSAVGDWVVAQLDAATSL

SEQ ID NO: 2853 - protein, 28 aa, Artificial Sequence
  Description of Artificial Sequence: Synthetic peptide
  C-term amidated
DDPKLYDKDLGSAVGDWVVAQMDAAWSL

SEQ ID NO: 2854 - protein, 28 aa, Artificial Sequence
  Description of Artificial Sequence: Synthetic peptide
DDPKLYDKDLGSAVGDWVVAQMDAAWSL

SEQ ID NO: 2855 - protein, 28 aa, Artificial Sequence
  Description of Artificial Sequence: Synthetic peptide
  C-term amidated
DDPKLYDKDLGSAVGDWVVAQMDAATSL

SEQ ID NO: 2856 - protein, 28 aa, Artificial Sequence
  Description of Artificial Sequence: Synthetic peptide
DDPKLYDKDLGSAVGDWVVAQMDAATSL

SEQ ID NO: 2857 - protein, 28 aa, Artificial Sequence
  Description of Artificial Sequence: Synthetic peptide
  C-term amidated
DDPKLYDKDLGSAVGDWVVGWVDAAWSL

SEQ ID NO: 2858 - protein, 28 aa, Artificial Sequence
  Description of Artificial Sequence: Synthetic peptide
DDPKLYDKDLGSAVGDWVVGWVDAAWSL

SEQ ID NO: 2859 - protein, 28 aa, Artificial Sequence
  Description of Artificial Sequence: Synthetic peptide
  C-term amidated
DDPKLYDKDLGSAVGDWVVGWVDAATSL

SEQ ID NO: 2860 - protein, 28 aa, Artificial Sequence
  Description of Artificial Sequence: Synthetic peptide
DDPKLYDKDLGSAVGDWVVGWVDAATSL

SEQ ID NO: 2861 - protein, 28 aa, Artificial Sequence
  Description of Artificial Sequence: Synthetic peptide
  C-term amidated
DDPKLYDKDLGSAVGDWVVGWLDAAWSL

SEQ ID NO: 2862 - protein, 28 aa, Artificial Sequence
  Description of Artificial Sequence: Synthetic peptide
DDPKLYDKDLGSAVGDWVVGWLDAAWSL

SEQ ID NO: 2863 - protein, 28 aa, Artificial Sequence
  Description of Artificial Sequence: Synthetic peptide
  C-term amidated
DDPKLYDKDLGSAVGDWVVGWLDAATSL

SEQ ID NO: 2864 - protein, 28 aa, Artificial Sequence
  Description of Artificial Sequence: Synthetic peptide
DDPKLYDKDLGSAVGDWVVGWLDAATSL

SEQ ID NO: 2865 - protein, 28 aa, Artificial Sequence
  Description of Artificial Sequence: Synthetic peptide
  C-term amidated
DDPKLYDKDLGSAVGDWVVGWMDAAWSL

SEQ ID NO: 2866 - protein, 28 aa, Artificial Sequence
  Description of Artificial Sequence: Synthetic peptide
DDPKLYDKDLGSAVGDWVVGWMDAAWSL

SEQ ID NO: 2867 - protein, 28 aa, Artificial Sequence
  Description of Artificial Sequence: Synthetic peptide
  C-term amidated
DDPKLYDKDLGSAVGDWVVGWMDAATSL

SEQ ID NO: 2868 - protein, 28 aa, Artificial Sequence
  Description of Artificial Sequence: Synthetic peptide
DDPKLYDKDLGSAVGDWVVGWMDAATSL

SEQ ID NO: 2869 - protein, 28 aa, Artificial Sequence
  Description of Artificial Sequence: Synthetic peptide
  C-term amidated
DDPKLYDKDLGSAVGDWVVGQVDAAWSL

SEQ ID NO: 2870 - protein, 28 aa, Artificial Sequence
  Description of Artificial Sequence: Synthetic peptide
DDPKLYDKDLGSAVGDWVVGQVDAAWSL

SEQ ID NO: 2871 - protein, 28 aa, Artificial Sequence
  Description of Artificial Sequence: Synthetic peptide
  C-term amidated
DDPKLYDKDLGSAVGDWVVGQVDAATSL

SEQ ID NO: 2872 - protein, 28 aa, Artificial Sequence
  Description of Artificial Sequence: Synthetic peptide
DDPKLYDKDLGSAVGDWVVGQVDAATSL

SEQ ID NO: 2873 - protein, 28 aa, Artificial Sequence
  Description of Artificial Sequence: Synthetic peptide
  C-term amidated
DDPKLYDKDLGSAVGDWVVGQLDAAWSL

SEQ ID NO: 2874 - protein, 28 aa, Artificial Sequence
  Description of Artificial Sequence: Synthetic peptide
DDPKLYDKDLGSAVGDWVVGQLDAAWSL

SEQ ID NO: 2875 - protein, 28 aa, Artificial Sequence
  Description of Artificial Sequence: Synthetic peptide
  C-term amidated
DDPKLYDKDLGSAVGDWVVGQLDAATSL

SEQ ID NO: 2876 - protein, 28 aa, Artificial Sequence
  Description of Artificial Sequence: Synthetic peptide
DDPKLYDKDLGSAVGDWVVGQLDAATSL

SEQ ID NO: 2877 - protein, 28 aa, Artificial Sequence
  Description of Artificial Sequence: Synthetic peptide
  C-term amidated
DDPKLYDKDLGSAVGDWVVGQMDAAWSL

SEQ ID NO: 2878 - protein, 28 aa, Artificial Sequence
  Description of Artificial Sequence: Synthetic peptide
DDPKLYDKDLGSAVGDWVVGQMDAAWSL

SEQ ID NO: 2879 - protein, 28 aa, Artificial Sequence
  Description of Artificial Sequence: Synthetic peptide
  C-term amidated
DDPKLYDKDLGSAVGDWVVGQMDAATSL

SEQ ID NO: 2880 - protein, 28 aa, Artificial Sequence
  Description of Artificial Sequence: Synthetic peptide
DDPKLYDKDLGSAVGDWVVGQMDAATSL

SEQ ID NO: 2881 - protein, 28 aa, Artificial Sequence
  Description of Artificial Sequence: Synthetic peptide
  C-term amidated
DDPKLYDKDLGSAVGDTVVAWVDAAWSL

SEQ ID NO: 2882 - protein, 28 aa, Artificial Sequence
  Description of Artificial Sequence: Synthetic peptide
DDPKLYDKDLGSAVGDTVVAWVDAAWSL

SEQ ID NO: 2883 - protein, 28 aa, Artificial Sequence
  Description of Artificial Sequence: Synthetic peptide
  C-term amidated
DDPKLYDKDLGSAVGDTVVAWVDAATSL

SEQ ID NO: 2884 - protein, 28 aa, Artificial Sequence
  Description of Artificial Sequence: Synthetic peptide
DDPKLYDKDLGSAVGDTVVAWVDAATSL

SEQ ID NO: 2885 - protein, 28 aa, Artificial Sequence
  Description of Artificial Sequence: Synthetic peptide
  C-term amidated
DDPKLYDKDLGSAVGDTVVAWLDAAWSL

SEQ ID NO: 2886 - protein, 28 aa, Artificial Sequence
  Description of Artificial Sequence: Synthetic peptide
DDPKLYDKDLGSAVGDTVVAWLDAAWSL

SEQ ID NO: 2887 - protein, 28 aa, Artificial Sequence
  Description of Artificial Sequence: Synthetic peptide
  C-term amidated
DDPKLYDKDLGSAVGDTVVAWLDAATSL

SEQ ID NO: 2888 - protein, 28 aa, Artificial Sequence
  Description of Artificial Sequence: Synthetic peptide
DDPKLYDKDLGSAVGDTVVAWLDAATSL

SEQ ID NO: 2889 - protein, 28 aa, Artificial Sequence
  Description of Artificial Sequence: Synthetic peptide
  C-term amidated
DDPKLYDKDLGSAVGDTVVAWMDAAWSL

SEQ ID NO: 2890 - protein, 28 aa, Artificial Sequence
  Description of Artificial Sequence: Synthetic peptide
DDPKLYDKDLGSAVGDTVVAWMDAAWSL

SEQ ID NO: 2891 - protein, 28 aa, Artificial Sequence
  Description of Artificial Sequence: Synthetic peptide
  C-term amidated
DDPKLYDKDLGSAVGDTVVAWMDAATSL

SEQ ID NO: 2892 - protein, 28 aa, Artificial Sequence
  Description of Artificial Sequence: Synthetic peptide
DDPKLYDKDLGSAVGDTVVAWMDAATSL

SEQ ID NO: 2893 - protein, 28 aa, Artificial Sequence
  Description of Artificial Sequence: Synthetic peptide
  C-term amidated
DDPKLYDKDLGSAVGDTVVAQVDAAWSL

SEQ ID NO: 2894 - protein, 28 aa, Artificial Sequence
  Description of Artificial Sequence: Synthetic peptide
DDPKLYDKDLGSAVGDTVVAQVDAAWSL

SEQ ID NO: 2895 - protein, 28 aa, Artificial Sequence
  Description of Artificial Sequence: Synthetic peptide
  C-term amidated
DDPKLYDKDLGSAVGDTVVAQVDAATSL

SEQ ID NO: 2896 - protein, 28 aa, Artificial Sequence
  Description of Artificial Sequence: Synthetic peptide
DDPKLYDKDLGSAVGDTVVAQVDAATSL

SEQ ID NO: 2897 - protein, 28 aa, Artificial Sequence
  Description of Artificial Sequence: Synthetic peptide
  C-term amidated
DDPKLYDKDLGSAVGDTVVAQLDAAWSL

SEQ ID NO: 2898 - protein, 28 aa, Artificial Sequence
  Description of Artificial Sequence: Synthetic peptide
DDPKLYDKDLGSAVGDTVVAQLDAAWSL

SEQ ID NO: 2899 - protein, 28 aa, Artificial Sequence
  Description of Artificial Sequence: Synthetic peptide
  C-term amidated
DDPKLYDKDLGSAVGDTVVAQLDAATSL

SEQ ID NO: 2900 - protein, 28 aa, Artificial Sequence
  Description of Artificial Sequence: Synthetic peptide
DDPKLYDKDLGSAVGDTVVAQLDAATSL

SEQ ID NO: 2901 - protein, 28 aa, Artificial Sequence
  Description of Artificial Sequence: Synthetic peptide
  C-term amidated
DDPKLYDKDLGSAVGDTVVAQMDAAWSL

SEQ ID NO: 2902 - protein, 28 aa, Artificial Sequence
  Description of Artificial Sequence: Synthetic peptide
DDPKLYDKDLGSAVGDTVVAQMDAAWSL

SEQ ID NO: 2903 - protein, 28 aa, Artificial Sequence
  Description of Artificial Sequence: Synthetic peptide
  C-term amidated
DDPKLYDKDLGSAVGDTVVAQMDAATSL

SEQ ID NO: 2904 - protein, 28 aa, Artificial Sequence
  Description of Artificial Sequence: Synthetic peptide
DDPKLYDKDLGSAVGDTVVAQMDAATSL

SEQ ID NO: 2905 - protein, 28 aa, Artificial Sequence
  Description of Artificial Sequence: Synthetic peptide
  C-term amidated
DDPKLYDKDLGSAVGDTVVGWVDAAWSL

SEQ ID NO: 2906 - protein, 28 aa, Artificial Sequence
  Description of Artificial Sequence: Synthetic peptide
DDPKLYDKDLGSAVGDTVVGWVDAAWSL

SEQ ID NO: 2907 - protein, 28 aa, Artificial Sequence
  Description of Artificial Sequence: Synthetic peptide
  C-term amidated
DDPKLYDKDLGSAVGDTVVGWVDAATSL

SEQ ID NO: 2908 - protein, 28 aa, Artificial Sequence
  Description of Artificial Sequence: Synthetic peptide
DDPKLYDKDLGSAVGDTVVGWVDAATSL

SEQ ID NO: 2909 - protein, 28 aa, Artificial Sequence
  Description of Artificial Sequence: Synthetic peptide
  C-term amidated
DDPKLYDKDLGSAVGDTVVGWLDAAWSL

SEQ ID NO: 2910 - protein, 28 aa, Artificial Sequence
  Description of Artificial Sequence: Synthetic peptide
DDPKLYDKDLGSAVGDTVVGWLDAAWSL

SEQ ID NO: 2911 - protein, 28 aa, Artificial Sequence
  Description of Artificial Sequence: Synthetic peptide
  C-term amidated
DDPKLYDKDLGSAVGDTVVGWLDAATSL

SEQ ID NO: 2912 - protein, 28 aa, Artificial Sequence
  Description of Artificial Sequence: Synthetic peptide
DDPKLYDKDLGSAVGDTVVGWLDAATSL

SEQ ID NO: 2913 - protein, 28 aa, Artificial Sequence
  Description of Artificial Sequence: Synthetic peptide
  C-term amidated
DDPKLYDKDLGSAVGDTVVGWMDAAWSL

SEQ ID NO: 2914 - protein, 28 aa, Artificial Sequence
  Description of Artificial Sequence: Synthetic peptide
DDPKLYDKDLGSAVGDTVVGWMDAAWSL

SEQ ID NO: 2915 - protein, 28 aa, Artificial Sequence
  Description of Artificial Sequence: Synthetic peptide
  C-term amidated
DDPKLYDKDLGSAVGDTVVGWMDAATSL

SEQ ID NO: 2916 - protein, 28 aa, Artificial Sequence
  Description of Artificial Sequence: Synthetic peptide
DDPKLYDKDLGSAVGDTVVGWMDAATSL

SEQ ID NO: 2917 - protein, 28 aa, Artificial Sequence
  Description of Artificial Sequence: Synthetic peptide
  C-term amidated
DDPKLYDKDLGSAVGDTVVGQVDAAWSL

SEQ ID NO: 2918 - protein, 28 aa, Artificial Sequence
  Description of Artificial Sequence: Synthetic peptide
DDPKLYDKDLGSAVGDTVVGQVDAAWSL

SEQ ID NO: 2919 - protein, 28 aa, Artificial Sequence
  Description of Artificial Sequence: Synthetic peptide
  C-term amidated
DDPKLYDKDLGSAVGDTVVGQVDAATSL

SEQ ID NO: 2920 - protein, 28 aa, Artificial Sequence
  Description of Artificial Sequence: Synthetic peptide
DDPKLYDKDLGSAVGDTVVGQVDAATSL

SEQ ID NO: 2921 - protein, 28 aa, Artificial Sequence
  Description of Artificial Sequence: Synthetic peptide
  C-term amidated
DDPKLYDKDLGSAVGDTVVGQLDAAWSL

SEQ ID NO: 2922 - protein, 28 aa, Artificial Sequence
  Description of Artificial Sequence: Synthetic peptide
DDPKLYDKDLGSAVGDTVVGQLDAAWSL

SEQ ID NO: 2923 - protein, 28 aa, Artificial Sequence
  Description of Artificial Sequence: Synthetic peptide
  C-term amidated
DDPKLYDKDLGSAVGDTVVGQLDAATSL

SEQ ID NO: 2924 - protein, 28 aa, Artificial Sequence
  Description of Artificial Sequence: Synthetic peptide
DDPKLYDKDLGSAVGDTVVGQLDAATSL

SEQ ID NO: 2925 - protein, 28 aa, Artificial Sequence
  Description of Artificial Sequence: Synthetic peptide
  C-term amidated
DDPKLYDKDLGSAVGDTVVGQMDAAWSL

SEQ ID NO: 2926 - protein, 28 aa, Artificial Sequence
  Description of Artificial Sequence: Synthetic peptide
DDPKLYDKDLGSAVGDTVVGQMDAAWSL

SEQ ID NO: 2927 - protein, 28 aa, Artificial Sequence
  Description of Artificial Sequence: Synthetic peptide
  C-term amidated
DDPKLYDKDLGSAVGDTVVGQMDAATSL

SEQ ID NO: 2928 - protein, 28 aa, Artificial Sequence
  Description of Artificial Sequence: Synthetic peptide
DDPKLYDKDLGSAVGDTVVGQMDAATSL

SEQ ID NO: 2929 - protein, 28 aa, Artificial Sequence
  Description of Artificial Sequence: Synthetic peptide
  C-term amidated
DDPKLYDKDLGSALWDWVVAWVDAAWSL

SEQ ID NO: 2930 - protein, 28 aa, Artificial Sequence
  Description of Artificial Sequence: Synthetic peptide
DDPKLYDKDLGSALWDWVVAWVDAAWSL

SEQ ID NO: 2931 - protein, 28 aa, Artificial Sequence
  Description of Artificial Sequence: Synthetic peptide
  C-term amidated
DDPKLYDKDLGSALWDWVVAWVDAATSL

SEQ ID NO: 2932 - protein, 28 aa, Artificial Sequence
  Description of Artificial Sequence: Synthetic peptide
DDPKLYDKDLGSALWDWVVAWVDAATSL

SEQ ID NO: 2933 - protein, 28 aa, Artificial Sequence
  Description of Artificial Sequence: Synthetic peptide
  C-term amidated
DDPKLYDKDLGSALWDWVVAWLDAAWSL

SEQ ID NO: 2934 - protein, 28 aa, Artificial Sequence
  Description of Artificial Sequence: Synthetic peptide
DDPKLYDKDLGSALWDWVVAWLDAAWSL

SEQ ID NO: 2935 - protein, 28 aa, Artificial Sequence
  Description of Artificial Sequence: Synthetic peptide
  C-term amidated
DDPKLYDKDLGSALWDWVVAWLDAATSL

SEQ ID NO: 2936 - protein, 28 aa, Artificial Sequence
  Description of Artificial Sequence: Synthetic peptide
DDPKLYDKDLGSALWDWVVAWLDAATSL

SEQ ID NO: 2937 - protein, 28 aa, Artificial Sequence
  Description of Artificial Sequence: Synthetic peptide
  C-term amidated
DDPKLYDKDLGSALWDWVVAWMDAAWSL

SEQ ID NO: 2938 - protein, 28 aa, Artificial Sequence
  Description of Artificial Sequence: Synthetic peptide
DDPKLYDKDLGSALWDWVVAWMDAAWSL

SEQ ID NO: 2939 - protein, 28 aa, Artificial Sequence
  Description of Artificial Sequence: Synthetic peptide
  C-term amidated
DDPKLYDKDLGSALWDWVVAWMDAATSL

SEQ ID NO: 2940 - protein, 28 aa, Artificial Sequence
  Description of Artificial Sequence: Synthetic peptide
DDPKLYDKDLGSALWDWVVAWMDAATSL

SEQ ID NO: 2941 - protein, 28 aa, Artificial Sequence
  Description of Artificial Sequence: Synthetic peptide
  C-term amidated
DDPKLYDKDLGSALWDWVVAQVDAAWSL

SEQ ID NO: 2942 - protein, 28 aa, Artificial Sequence
  Description of Artificial Sequence: Synthetic peptide
DDPKLYDKDLGSALWDWVVAQVDAAWSL

SEQ ID NO: 2943 - protein, 28 aa, Artificial Sequence
  Description of Artificial Sequence: Synthetic peptide
  C-term amidated
DDPKLYDKDLGSALWDWVVAQVDAATSL

SEQ ID NO: 2944 - protein, 28 aa, Artificial Sequence
  Description of Artificial Sequence: Synthetic peptide
DDPKLYDKDLGSALWDWVVAQVDAATSL

SEQ ID NO: 2945 - protein, 28 aa, Artificial Sequence
  Description of Artificial Sequence: Synthetic peptide
  C-term amidated
DDPKLYDKDLGSALWDWVVAQLDAAWSL

SEQ ID NO: 2946 - protein, 28 aa, Artificial Sequence
  Description of Artificial Sequence: Synthetic peptide
DDPKLYDKDLGSALWDWVVAQLDAAWSL

SEQ ID NO: 2947 - protein, 28 aa, Artificial Sequence
  Description of Artificial Sequence: Synthetic peptide
  C-term amidated
DDPKLYDKDLGSALWDWVVAQLDAATSL

SEQ ID NO: 2948 - protein, 28 aa, Artificial Sequence
  Description of Artificial Sequence: Synthetic peptide
DDPKLYDKDLGSALWDWVVAQLDAATSL

SEQ ID NO: 2949 - protein, 28 aa, Artificial Sequence
  Description of Artificial Sequence: Synthetic peptide
  C-term amidated
DDPKLYDKDLGSALWDWVVAQMDAAWSL

SEQ ID NO: 2950 - protein, 28 aa, Artificial Sequence
  Description of Artificial Sequence: Synthetic peptide
DDPKLYDKDLGSALWDWVVAQMDAAWSL

SEQ ID NO: 2951 - protein, 28 aa, Artificial Sequence
  Description of Artificial Sequence: Synthetic peptide
  C-term amidated
DDPKLYDKDLGSALWDWVVAQMDAATSL

SEQ ID NO: 2952 - protein, 28 aa, Artificial Sequence
  Description of Artificial Sequence: Synthetic peptide
DDPKLYDKDLGSALWDWVVAQMDAATSL

SEQ ID NO: 2953 - protein, 28 aa, Artificial Sequence
  Description of Artificial Sequence: Synthetic peptide
  C-term amidated
DDPKLYDKDLGSALWDWVVGWVDAAWSL

SEQ ID NO: 2954 - protein, 28 aa, Artificial Sequence
  Description of Artificial Sequence: Synthetic peptide
DDPKLYDKDLGSALWDWVVGWVDAAWSL

SEQ ID NO: 2955 - protein, 28 aa, Artificial Sequence
  Description of Artificial Sequence: Synthetic peptide
  C-term amidated
DDPKLYDKDLGSALWDWVVGWVDAATSL

SEQ ID NO: 2956 - protein, 28 aa, Artificial Sequence
  Description of Artificial Sequence: Synthetic peptide
DDPKLYDKDLGSALWDWVVGWVDAATSL

SEQ ID NO: 2957 - protein, 28 aa, Artificial Sequence
  Description of Artificial Sequence: Synthetic peptide
  C-term amidated
DDPKLYDKDLGSALWDWVVGWLDAAWSL

SEQ ID NO: 2958 - protein, 28 aa, Artificial Sequence
  Description of Artificial Sequence: Synthetic peptide
DDPKLYDKDLGSALWDWVVGWLDAAWSL

SEQ ID NO: 2959 - protein, 28 aa, Artificial Sequence
  Description of Artificial Sequence: Synthetic peptide
  C-term amidated
DDPKLYDKDLGSALWDWVVGWLDAATSL

SEQ ID NO: 2960 - protein, 28 aa, Artificial Sequence
  Description of Artificial Sequence: Synthetic peptide
DDPKLYDKDLGSALWDWVVGWLDAATSL

SEQ ID NO: 2961 - protein, 28 aa, Artificial Sequence
  Description of Artificial Sequence: Synthetic peptide
  C-term amidated
DDPKLYDKDLGSALWDWVVGWMDAAWSL

SEQ ID NO: 2962 - protein, 28 aa, Artificial Sequence
  Description of Artificial Sequence: Synthetic peptide
DDPKLYDKDLGSALWDWVVGWMDAAWSL

SEQ ID NO: 2963 - protein, 28 aa, Artificial Sequence
  Description of Artificial Sequence: Synthetic peptide
  C-term amidated
DDPKLYDKDLGSALWDWVVGWMDAATSL

SEQ ID NO: 2964 - protein, 28 aa, Artificial Sequence
  Description of Artificial Sequence: Synthetic peptide
DDPKLYDKDLGSALWDWVVGWMDAATSL

SEQ ID NO: 2965 - protein, 28 aa, Artificial Sequence
  Description of Artificial Sequence: Synthetic peptide
  C-term amidated
DDPKLYDKDLGSALWDWVVGQVDAAWSL

SEQ ID NO: 2966 - protein, 28 aa, Artificial Sequence
  Description of Artificial Sequence: Synthetic peptide
DDPKLYDKDLGSALWDWVVGQVDAAWSL

SEQ ID NO: 2967 - protein, 28 aa, Artificial Sequence
  Description of Artificial Sequence: Synthetic peptide
  C-term amidated
DDPKLYDKDLGSALWDWVVGQVDAATSL

SEQ ID NO: 2968 - protein, 28 aa, Artificial Sequence
  Description of Artificial Sequence: Synthetic peptide
DDPKLYDKDLGSALWDWVVGQVDAATSL

SEQ ID NO: 2969 - protein, 28 aa, Artificial Sequence
  Description of Artificial Sequence: Synthetic peptide
  C-term amidated
DDPKLYDKDLGSALWDWVVGQLDAAWSL

SEQ ID NO: 2970 - protein, 28 aa, Artificial Sequence
  Description of Artificial Sequence: Synthetic peptide
DDPKLYDKDLGSALWDWVVGQLDAAWSL

SEQ ID NO: 2971 - protein, 28 aa, Artificial Sequence
  Description of Artificial Sequence: Synthetic peptide
  C-term amidated
DDPKLYDKDLGSALWDWVVGQLDAATSL

SEQ ID NO: 2972 - protein, 28 aa, Artificial Sequence
  Description of Artificial Sequence: Synthetic peptide
DDPKLYDKDLGSALWDWVVGQLDAATSL

SEQ ID NO: 2973 - protein, 28 aa, Artificial Sequence
  Description of Artificial Sequence: Synthetic peptide
  C-term amidated
DDPKLYDKDLGSALWDWVVGQMDAAWSL

SEQ ID NO: 2974 - protein, 28 aa, Artificial Sequence
  Description of Artificial Sequence: Synthetic peptide
DDPKLYDKDLGSALWDWVVGQMDAAWSL

SEQ ID NO: 2975 - protein, 28 aa, Artificial Sequence
  Description of Artificial Sequence: Synthetic peptide
  C-term amidated
DDPKLYDKDLGSALWDWVVGQMDAATSL

SEQ ID NO: 2976 - protein, 28 aa, Artificial Sequence
  Description of Artificial Sequence: Synthetic peptide
DDPKLYDKDLGSALWDWVVGQMDAATSL

SEQ ID NO: 2977 - protein, 28 aa, Artificial Sequence
  Description of Artificial Sequence: Synthetic peptide
  C-term amidated
DDPKLYDKDLGSALWDTVVAWVDAAWSL

SEQ ID NO: 2978 - protein, 28 aa, Artificial Sequence
  Description of Artificial Sequence: Synthetic peptide
DDPKLYDKDLGSALWDTVVAWVDAAWSL

SEQ ID NO: 2979 - protein, 28 aa, Artificial Sequence
  Description of Artificial Sequence: Synthetic peptide
  C-term amidated
DDPKLYDKDLGSALWDTVVAWVDAATSL

SEQ ID NO: 2980 - protein, 28 aa, Artificial Sequence
  Description of Artificial Sequence: Synthetic peptide
DDPKLYDKDLGSALWDTVVAWVDAATSL

SEQ ID NO: 2981 - protein, 28 aa, Artificial Sequence
  Description of Artificial Sequence: Synthetic peptide
  C-term amidated
DDPKLYDKDLGSALWDTVVAWLDAAWSL

SEQ ID NO: 2982 - protein, 28 aa, Artificial Sequence
  Description of Artificial Sequence: Synthetic peptide
DDPKLYDKDLGSALWDTVVAWLDAAWSL

SEQ ID NO: 2983 - protein, 28 aa, Artificial Sequence
  Description of Artificial Sequence: Synthetic peptide
  C-term amidated
DDPKLYDKDLGSALWDTVVAWLDAATSL

SEQ ID NO: 2984 - protein, 28 aa, Artificial Sequence
  Description of Artificial Sequence: Synthetic peptide
DDPKLYDKDLGSALWDTVVAWLDAATSL

SEQ ID NO: 2985 - protein, 28 aa, Artificial Sequence
  Description of Artificial Sequence: Synthetic peptide
  C-term amidated
DDPKLYDKDLGSALWDTVVAWMDAAWSL

SEQ ID NO: 2986 - protein, 28 aa, Artificial Sequence
  Description of Artificial Sequence: Synthetic peptide
DDPKLYDKDLGSALWDTVVAWMDAAWSL

SEQ ID NO: 2987 - protein, 28 aa, Artificial Sequence
  Description of Artificial Sequence: Synthetic peptide
  C-term amidated
DDPKLYDKDLGSALWDTVVAWMDAATSL

SEQ ID NO: 2988 - protein, 28 aa, Artificial Sequence
  Description of Artificial Sequence: Synthetic peptide
DDPKLYDKDLGSALWDTVVAWMDAATSL

SEQ ID NO: 2989 - protein, 28 aa, Artificial Sequence
  Description of Artificial Sequence: Synthetic peptide
  C-term amidated
DDPKLYDKDLGSALWDTVVAQVDAAWSL

SEQ ID NO: 2990 - protein, 28 aa, Artificial Sequence
  Description of Artificial Sequence: Synthetic peptide
DDPKLYDKDLGSALWDTVVAQVDAAWSL

SEQ ID NO: 2991 - protein, 28 aa, Artificial Sequence
  Description of Artificial Sequence: Synthetic peptide
  C-term amidated
DDPKLYDKDLGSALWDTVVAQVDAATSL

SEQ ID NO: 2992 - protein, 28 aa, Artificial Sequence
  Description of Artificial Sequence: Synthetic peptide
DDPKLYDKDLGSALWDTVVAQVDAATSL

SEQ ID NO: 2993 - protein, 28 aa, Artificial Sequence
  Description of Artificial Sequence: Synthetic peptide
  C-term amidated
DDPKLYDKDLGSALWDTVVAQLDAAWSL

SEQ ID NO: 2994 - protein, 28 aa, Artificial Sequence
  Description of Artificial Sequence: Synthetic peptide
DDPKLYDKDLGSALWDTVVAQLDAAWSL

SEQ ID NO: 2995 - protein, 28 aa, Artificial Sequence
  Description of Artificial Sequence: Synthetic peptide
  C-term amidated
DDPKLYDKDLGSALWDTVVAQLDAATSL

SEQ ID NO: 2996 - protein, 28 aa, Artificial Sequence
  Description of Artificial Sequence: Synthetic peptide
DDPKLYDKDLGSALWDTVVAQLDAATSL

SEQ ID NO: 2997 - protein, 28 aa, Artificial Sequence
  Description of Artificial Sequence: Synthetic peptide
  C-term amidated
DDPKLYDKDLGSALWDTVVAQMDAAWSL

SEQ ID NO: 2998 - protein, 28 aa, Artificial Sequence
  Description of Artificial Sequence: Synthetic peptide
DDPKLYDKDLGSALWDTVVAQMDAAWSL

SEQ ID NO: 2999 - protein, 28 aa, Artificial Sequence
  Description of Artificial Sequence: Synthetic peptide
  C-term amidated
DDPKLYDKDLGSALWDTVVAQMDAATSL

SEQ ID NO: 3000 - protein, 28 aa, Artificial Sequence
  Description of Artificial Sequence: Synthetic peptide
DDPKLYDKDLGSALWDTVVAQMDAATSL

SEQ ID NO: 3001 - protein, 28 aa, Artificial Sequence
  Description of Artificial Sequence: Synthetic peptide
  C-term amidated
DDPKLYDKDLGSALWDTVVGWVDAAWSL

SEQ ID NO: 3002 - protein, 28 aa, Artificial Sequence
  Description of Artificial Sequence: Synthetic peptide
DDPKLYDKDLGSALWDTVVGWVDAAWSL

SEQ ID NO: 3003 - protein, 28 aa, Artificial Sequence
  Description of Artificial Sequence: Synthetic peptide
  C-term amidated
DDPKLYDKDLGSALWDTVVGWVDAATSL

SEQ ID NO: 3004 - protein, 28 aa, Artificial Sequence
  Description of Artificial Sequence: Synthetic peptide
DDPKLYDKDLGSALWDTVVGWVDAATSL

SEQ ID NO: 3005 - protein, 28 aa, Artificial Sequence
  Description of Artificial Sequence: Synthetic peptide
  C-term amidated
DDPKLYDKDLGSALWDTVVGWLDAAWSL

SEQ ID NO: 3006 - protein, 28 aa, Artificial Sequence
  Description of Artificial Sequence: Synthetic peptide
DDPKLYDKDLGSALWDTVVGWLDAAWSL

SEQ ID NO: 3007 - protein, 28 aa, Artificial Sequence
  Description of Artificial Sequence: Synthetic peptide
  C-term amidated
DDPKLYDKDLGSALWDTVVGWLDAATSL

SEQ ID NO: 3008 - protein, 28 aa, Artificial Sequence
  Description of Artificial Sequence: Synthetic peptide
DDPKLYDKDLGSALWDTVVGWLDAATSL

SEQ ID NO: 3009 - protein, 28 aa, Artificial Sequence
  Description of Artificial Sequence: Synthetic peptide
  C-term amidated
DDPKLYDKDLGSALWDTVVGWMDAAWSL

SEQ ID NO: 3010 - protein, 28 aa, Artificial Sequence
  Description of Artificial Sequence: Synthetic peptide
DDPKLYDKDLGSALWDTVVGWMDAAWSL

SEQ ID NO: 3011 - protein, 28 aa, Artificial Sequence
  Description of Artificial Sequence: Synthetic peptide
  C-term amidated
DDPKLYDKDLGSALWDTVVGWMDAATSL

SEQ ID NO: 3012 - protein, 28 aa, Artificial Sequence
  Description of Artificial Sequence: Synthetic peptide
DDPKLYDKDLGSALWDTVVGWMDAATSL

SEQ ID NO: 3013 - protein, 28 aa, Artificial Sequence
  Description of Artificial Sequence: Synthetic peptide
  C-term amidated
DDPKLYDKDLGSALWDTVVGQVDAAWSL

SEQ ID NO: 3014 - protein, 28 aa, Artificial Sequence
  Description of Artificial Sequence: Synthetic peptide
DDPKLYDKDLGSALWDTVVGQVDAAWSL

SEQ ID NO: 3015 - protein, 28 aa, Artificial Sequence
  Description of Artificial Sequence: Synthetic peptide
  C-term amidated
DDPKLYDKDLGSALWDTVVGQVDAATSL

SEQ ID NO: 3016 - protein, 28 aa, Artificial Sequence
  Description of Artificial Sequence: Synthetic peptide
DDPKLYDKDLGSALWDTVVGQVDAATSL

SEQ ID NO: 3017 - protein, 28 aa, Artificial Sequence
  Description of Artificial Sequence: Synthetic peptide
  C-term amidated
DDPKLYDKDLGSALWDTVVGQLDAAWSL

SEQ ID NO: 3018 - protein, 28 aa, Artificial Sequence
  Description of Artificial Sequence: Synthetic peptide
DDPKLYDKDLGSALWDTVVGQLDAAWSL

SEQ ID NO: 3019 - protein, 28 aa, Artificial Sequence
  Description of Artificial Sequence: Synthetic peptide
  C-term amidated
DDPKLYDKDLGSALWDTVVGQLDAATSL

SEQ ID NO: 3020 - protein, 28 aa, Artificial Sequence
  Description of Artificial Sequence: Synthetic peptide
DDPKLYDKDLGSALWDTVVGQLDAATSL

SEQ ID NO: 3021 - protein, 28 aa, Artificial Sequence
  Description of Artificial Sequence: Synthetic peptide
  C-term amidated
DDPKLYDKDLGSALWDTVVGQMDAAWSL

SEQ ID NO: 3022 - protein, 28 aa, Artificial Sequence
  Description of Artificial Sequence: Synthetic peptide
DDPKLYDKDLGSALWDTVVGQMDAAWSL

SEQ ID NO: 3023 - protein, 28 aa, Artificial Sequence
  Description of Artificial Sequence: Synthetic peptide
  C-term amidated
DDPKLYDKDLGSALWDTVVGQMDAATSL

SEQ ID NO: 3024 - protein, 28 aa, Artificial Sequence
  Description of Artificial Sequence: Synthetic peptide
DDPKLYDKDLGSALWDTVVGQMDAATSL

SEQ ID NO: 3025 - protein, 28 aa, Artificial Sequence
  Description of Artificial Sequence: Synthetic peptide
  C-term amidated
DDPKLYDKDLGSALTDWVVAWVDAAWSL

SEQ ID NO: 3026 - protein, 28 aa, Artificial Sequence
  Description of Artificial Sequence: Synthetic peptide
DDPKLYDKDLGSALTDWVVAWVDAAWSL

SEQ ID NO: 3027 - protein, 28 aa, Artificial Sequence
  Description of Artificial Sequence: Synthetic peptide
  C-term amidated
DDPKLYDKDLGSALTDWVVAWVDAATSL

SEQ ID NO: 3028 - protein, 28 aa, Artificial Sequence
  Description of Artificial Sequence: Synthetic peptide
DDPKLYDKDLGSALTDWVVAWVDAATSL

SEQ ID NO: 3029 - protein, 28 aa, Artificial Sequence
  Description of Artificial Sequence: Synthetic peptide
  C-term amidated
DDPKLYDKDLGSALTDWVVAWLDAAWSL

SEQ ID NO: 3030 - protein, 28 aa, Artificial Sequence
  Description of Artificial Sequence: Synthetic peptide
DDPKLYDKDLGSALTDWVVAWLDAAWSL

SEQ ID NO: 3031 - protein, 28 aa, Artificial Sequence
  Description of Artificial Sequence: Synthetic peptide
  C-term amidated
DDPKLYDKDLGSALTDWVVAWLDAATSL

SEQ ID NO: 3032 - protein, 28 aa, Artificial Sequence
  Description of Artificial Sequence: Synthetic peptide
DDPKLYDKDLGSALTDWVVAWLDAATSL

SEQ ID NO: 3033 - protein, 28 aa, Artificial Sequence
  Description of Artificial Sequence: Synthetic peptide
  C-term amidated
DDPKLYDKDLGSALTDWVVAWMDAAWSL

SEQ ID NO: 3034 - protein, 28 aa, Artificial Sequence
  Description of Artificial Sequence: Synthetic peptide
DDPKLYDKDLGSALTDWVVAWMDAAWSL

SEQ ID NO: 3035 - protein, 28 aa, Artificial Sequence
  Description of Artificial Sequence: Synthetic peptide
  C-term amidated
DDPKLYDKDLGSALTDWVVAWMDAATSL

SEQ ID NO: 3036 - protein, 28 aa, Artificial Sequence
  Description of Artificial Sequence: Synthetic peptide
DDPKLYDKDLGSALTDWVVAWMDAATSL

SEQ ID NO: 3037 - protein, 28 aa, Artificial Sequence
  Description of Artificial Sequence: Synthetic peptide
  C-term amidated
DDPKLYDKDLGSALTDWVVAQVDAAWSL

SEQ ID NO: 3038 - protein, 28 aa, Artificial Sequence
  Description of Artificial Sequence: Synthetic peptide
DDPKLYDKDLGSALTDWVVAQVDAAWSL

SEQ ID NO: 3039 - protein, 28 aa, Artificial Sequence
  Description of Artificial Sequence: Synthetic peptide
  C-term amidated
DDPKLYDKDLGSALTDWVVAQVDAATSL

SEQ ID NO: 3040 - protein, 28 aa, Artificial Sequence
  Description of Artificial Sequence: Synthetic peptide
DDPKLYDKDLGSALTDWVVAQVDAATSL

SEQ ID NO: 3041 - protein, 28 aa, Artificial Sequence
  Description of Artificial Sequence: Synthetic peptide
  C-term amidated
DDPKLYDKDLGSALTDWVVAQLDAAWSL

SEQ ID NO: 3042 - protein, 28 aa, Artificial Sequence
  Description of Artificial Sequence: Synthetic peptide
DDPKLYDKDLGSALTDWVVAQLDAAWSL

SEQ ID NO: 3043 - protein, 28 aa, Artificial Sequence
  Description of Artificial Sequence: Synthetic peptide
  C-term amidated
DDPKLYDKDLGSALTDWVVAQLDAATSL

SEQ ID NO: 3044 - protein, 28 aa, Artificial Sequence
  Description of Artificial Sequence: Synthetic peptide
DDPKLYDKDLGSALTDWVVAQLDAATSL

SEQ ID NO: 3045 - protein, 28 aa, Artificial Sequence
  Description of Artificial Sequence: Synthetic peptide
  C-term amidated
DDPKLYDKDLGSALTDWVVAQMDAAWSL

SEQ ID NO: 3046 - protein, 28 aa, Artificial Sequence
  Description of Artificial Sequence: Synthetic peptide
DDPKLYDKDLGSALTDWVVAQMDAAWSL

SEQ ID NO: 3047 - protein, 28 aa, Artificial Sequence
  Description of Artificial Sequence: Synthetic peptide
  C-term amidated
DDPKLYDKDLGSALTDWVVAQMDAATSL

SEQ ID NO: 3048 - protein, 28 aa, Artificial Sequence
  Description of Artificial Sequence: Synthetic peptide
DDPKLYDKDLGSALTDWVVAQMDAATSL

SEQ ID NO: 3049 - protein, 28 aa, Artificial Sequence
  Description of Artificial Sequence: Synthetic peptide
  C-term amidated
DDPKLYDKDLGSALTDWVVGWVDAAWSL

SEQ ID NO: 3050 - protein, 28 aa, Artificial Sequence
  Description of Artificial Sequence: Synthetic peptide
DDPKLYDKDLGSALTDWVVGWVDAAWSL

SEQ ID NO: 3051 - protein, 28 aa, Artificial Sequence
  Description of Artificial Sequence: Synthetic peptide
  C-term amidated
DDPKLYDKDLGSALTDWVVGWVDAATSL

SEQ ID NO: 3052 - protein, 28 aa, Artificial Sequence
  Description of Artificial Sequence: Synthetic peptide
DDPKLYDKDLGSALTDWVVGWVDAATSL

SEQ ID NO: 3053 - protein, 28 aa, Artificial Sequence
  Description of Artificial Sequence: Synthetic peptide
  C-term amidated
DDPKLYDKDLGSALTDWVVGWLDAAWSL

SEQ ID NO: 3054 - protein, 28 aa, Artificial Sequence
  Description of Artificial Sequence: Synthetic peptide
DDPKLYDKDLGSALTDWVVGWLDAAWSL

SEQ ID NO: 3055 - protein, 28 aa, Artificial Sequence
  Description of Artificial Sequence: Synthetic peptide
  C-term amidated
DDPKLYDKDLGSALTDWVVGWLDAATSL

SEQ ID NO: 3056 - protein, 28 aa, Artificial Sequence
  Description of Artificial Sequence: Synthetic peptide
DDPKLYDKDLGSALTDWVVGWLDAATSL

SEQ ID NO: 3057 - protein, 28 aa, Artificial Sequence
  Description of Artificial Sequence: Synthetic peptide
  C-term amidated
DDPKLYDKDLGSALTDWVVGWMDAAWSL

SEQ ID NO: 3058 - protein, 28 aa, Artificial Sequence
  Description of Artificial Sequence: Synthetic peptide
DDPKLYDKDLGSALTDWVVGWMDAAWSL

SEQ ID NO: 3059 - protein, 28 aa, Artificial Sequence
  Description of Artificial Sequence: Synthetic peptide
  C-term amidated
DDPKLYDKDLGSALTDWVVGWMDAATSL

SEQ ID NO: 3060 - protein, 28 aa, Artificial Sequence
  Description of Artificial Sequence: Synthetic peptide
DDPKLYDKDLGSALTDWVVGWMDAATSL

SEQ ID NO: 3061 - protein, 28 aa, Artificial Sequence
  Description of Artificial Sequence: Synthetic peptide
  C-term amidated
DDPKLYDKDLGSALTDWVVGQVDAAWSL

SEQ ID NO: 3062 - protein, 28 aa, Artificial Sequence
  Description of Artificial Sequence: Synthetic peptide
DDPKLYDKDLGSALTDWVVGQVDAAWSL

SEQ ID NO: 3063 - protein, 28 aa, Artificial Sequence
  Description of Artificial Sequence: Synthetic peptide
  C-term amidated
DDPKLYDKDLGSALTDWVVGQVDAATSL

SEQ ID NO: 3064 - protein, 28 aa, Artificial Sequence
  Description of Artificial Sequence: Synthetic peptide
DDPKLYDKDLGSALTDWVVGQVDAATSL

SEQ ID NO: 3065 - protein, 28 aa, Artificial Sequence
  Description of Artificial Sequence: Synthetic peptide
  C-term amidated
DDPKLYDKDLGSALTDWVVGQLDAAWSL

SEQ ID NO: 3066 - protein, 28 aa, Artificial Sequence
  Description of Artificial Sequence: Synthetic peptide
DDPKLYDKDLGSALTDWVVGQLDAAWSL

SEQ ID NO: 3067 - protein, 28 aa, Artificial Sequence
  Description of Artificial Sequence: Synthetic peptide
  C-term amidated
DDPKLYDKDLGSALTDWVVGQLDAATSL

SEQ ID NO: 3068 - protein, 28 aa, Artificial Sequence
  Description of Artificial Sequence: Synthetic peptide
DDPKLYDKDLGSALTDWVVGQLDAATSL

SEQ ID NO: 3069 - protein, 28 aa, Artificial Sequence
  Description of Artificial Sequence: Synthetic peptide
  C-term amidated
DDPKLYDKDLGSALTDWVVGQMDAAWSL

SEQ ID NO: 3070 - protein, 28 aa, Artificial Sequence
  Description of Artificial Sequence: Synthetic peptide
DDPKLYDKDLGSALTDWVVGQMDAAWSL

SEQ ID NO: 3071 - protein, 28 aa, Artificial Sequence
  Description of Artificial Sequence: Synthetic peptide
  C-term amidated
DDPKLYDKDLGSALTDWVVGQMDAATSL

SEQ ID NO: 3072 - protein, 28 aa, Artificial Sequence
  Description of Artificial Sequence: Synthetic peptide
DDPKLYDKDLGSALTDWVVGQMDAATSL

SEQ ID NO: 3073 - protein, 28 aa, Artificial Sequence
  Description of Artificial Sequence: Synthetic peptide
  C-term amidated
DDPKLYDKDLGSALTDTVVAWVDAAWSL

SEQ ID NO: 3074 - protein, 28 aa, Artificial Sequence
  Description of Artificial Sequence: Synthetic peptide
DDPKLYDKDLGSALTDTVVAWVDAAWSL

SEQ ID NO: 3075 - protein, 28 aa, Artificial Sequence
  Description of Artificial Sequence: Synthetic peptide
  C-term amidated
DDPKLYDKDLGSALTDTVVAWVDAATSL

SEQ ID NO: 3076 - protein, 28 aa, Artificial Sequence
  Description of Artificial Sequence: Synthetic peptide
DDPKLYDKDLGSALTDTVVAWVDAATSL

SEQ ID NO: 3077 - protein, 28 aa, Artificial Sequence
  Description of Artificial Sequence: Synthetic peptide
  C-term amidated
DDPKLYDKDLGSALTDTVVAWLDAAWSL

SEQ ID NO: 3078 - protein, 28 aa, Artificial Sequence
  Description of Artificial Sequence: Synthetic peptide
DDPKLYDKDLGSALTDTVVAWLDAAWSL

SEQ ID NO: 3079 - protein, 28 aa, Artificial Sequence
  Description of Artificial Sequence: Synthetic peptide
  C-term amidated
DDPKLYDKDLGSALTDTVVAWLDAATSL

SEQ ID NO: 3080 - protein, 28 aa, Artificial Sequence
  Description of Artificial Sequence: Synthetic peptide
DDPKLYDKDLGSALTDTVVAWLDAATSL

SEQ ID NO: 3081 - protein, 28 aa, Artificial Sequence
  Description of Artificial Sequence: Synthetic peptide
  C-term amidated
DDPKLYDKDLGSALTDTVVAWMDAAWSL

SEQ ID NO: 3082 - protein, 28 aa, Artificial Sequence
  Description of Artificial Sequence: Synthetic peptide
DDPKLYDKDLGSALTDTVVAWMDAAWSL

SEQ ID NO: 3083 - protein, 28 aa, Artificial Sequence
  Description of Artificial Sequence: Synthetic peptide
  C-term amidated
DDPKLYDKDLGSALTDTVVAWMDAATSL

SEQ ID NO: 3084 - protein, 28 aa, Artificial Sequence
  Description of Artificial Sequence: Synthetic peptide
DDPKLYDKDLGSALTDTVVAWMDAATSL

SEQ ID NO: 3085 - protein, 28 aa, Artificial Sequence
  Description of Artificial Sequence: Synthetic peptide
  C-term amidated
DDPKLYDKDLGSALTDTVVAQVDAAWSL

SEQ ID NO: 3086 - protein, 28 aa, Artificial Sequence
  Description of Artificial Sequence: Synthetic peptide
DDPKLYDKDLGSALTDTVVAQVDAAWSL

SEQ ID NO: 3087 - protein, 28 aa, Artificial Sequence
  Description of Artificial Sequence: Synthetic peptide
  C-term amidated
DDPKLYDKDLGSALTDTVVAQVDAATSL

SEQ ID NO: 3088 - protein, 28 aa, Artificial Sequence
  Description of Artificial Sequence: Synthetic peptide
DDPKLYDKDLGSALTDTVVAQVDAATSL

SEQ ID NO: 3089 - protein, 28 aa, Artificial Sequence
  Description of Artificial Sequence: Synthetic peptide
  C-term amidated
DDPKLYDKDLGSALTDTVVAQLDAAWSL

SEQ ID NO: 3090 - protein, 28 aa, Artificial Sequence
  Description of Artificial Sequence: Synthetic peptide
DDPKLYDKDLGSALTDTVVAQLDAAWSL

SEQ ID NO: 3091 - protein, 28 aa, Artificial Sequence
  Description of Artificial Sequence: Synthetic peptide
  C-term amidated
DDPKLYDKDLGSALTDTVVAQLDAATSL

SEQ ID NO: 3092 - protein, 28 aa, Artificial Sequence
  Description of Artificial Sequence: Synthetic peptide
DDPKLYDKDLGSALTDTVVAQLDAATSL

SEQ ID NO: 3093 - protein, 28 aa, Artificial Sequence
  Description of Artificial Sequence: Synthetic peptide
  C-term amidated
DDPKLYDKDLGSALTDTVVAQMDAAWSL

SEQ ID NO: 3094 - protein, 28 aa, Artificial Sequence
  Description of Artificial Sequence: Synthetic peptide
DDPKLYDKDLGSALTDTVVAQMDAAWSL

SEQ ID NO: 3095 - protein, 28 aa, Artificial Sequence
  Description of Artificial Sequence: Synthetic peptide
  C-term amidated
DDPKLYDKDLGSALTDTVVAQMDAATSL

SEQ ID NO: 3096 - protein, 28 aa, Artificial Sequence
  Description of Artificial Sequence: Synthetic peptide
DDPKLYDKDLGSALTDTVVAQMDAATSL

SEQ ID NO: 3097 - protein, 28 aa, Artificial Sequence
  Description of Artificial Sequence: Synthetic peptide
  C-term amidated
DDPKLYDKDLGSALTDTVVGWVDAAWSL

SEQ ID NO: 3098 - protein, 28 aa, Artificial Sequence
  Description of Artificial Sequence: Synthetic peptide
DDPKLYDKDLGSALTDTVVGWVDAAWSL

SEQ ID NO: 3099 - protein, 28 aa, Artificial Sequence
  Description of Artificial Sequence: Synthetic peptide
  C-term amidated
DDPKLYDKDLGSALTDTVVGWVDAATSL

SEQ ID NO: 3100 - protein, 28 aa, Artificial Sequence
  Description of Artificial Sequence: Synthetic peptide
DDPKLYDKDLGSALTDTVVGWVDAATSL

SEQ ID NO: 3101 - protein, 28 aa, Artificial Sequence
  Description of Artificial Sequence: Synthetic peptide
  C-term amidated
DDPKLYDKDLGSALTDTVVGWLDAAWSL

SEQ ID NO: 3102 - protein, 28 aa, Artificial Sequence
  Description of Artificial Sequence: Synthetic peptide
DDPKLYDKDLGSALTDTVVGWLDAAWSL

SEQ ID NO: 3103 - protein, 28 aa, Artificial Sequence
  Description of Artificial Sequence: Synthetic peptide
  C-term amidated
DDPKLYDKDLGSALTDTVVGWLDAATSL

SEQ ID NO: 3104 - protein, 28 aa, Artificial Sequence
  Description of Artificial Sequence: Synthetic peptide
DDPKLYDKDLGSALTDTVVGWLDAATSL

SEQ ID NO: 3105 - protein, 28 aa, Artificial Sequence
  Description of Artificial Sequence: Synthetic peptide
  C-term amidated
DDPKLYDKDLGSALTDTVVGWMDAAWSL

SEQ ID NO: 3106 - protein, 28 aa, Artificial Sequence
  Description of Artificial Sequence: Synthetic peptide
DDPKLYDKDLGSALTDTVVGWMDAAWSL

SEQ ID NO: 3107 - protein, 28 aa, Artificial Sequence
  Description of Artificial Sequence: Synthetic peptide
  C-term amidated
DDPKLYDKDLGSALTDTVVGWMDAATSL

SEQ ID NO: 3108 - protein, 28 aa, Artificial Sequence
  Description of Artificial Sequence: Synthetic peptide
DDPKLYDKDLGSALTDTVVGWMDAATSL

SEQ ID NO: 3109 - protein, 28 aa, Artificial Sequence
  Description of Artificial Sequence: Synthetic peptide
  C-term amidated
DDPKLYDKDLGSALTDTVVGQVDAAWSL

SEQ ID NO: 3110 - protein, 28 aa, Artificial Sequence
  Description of Artificial Sequence: Synthetic peptide
DDPKLYDKDLGSALTDTVVGQVDAAWSL

SEQ ID NO: 3111 - protein, 28 aa, Artificial Sequence
  Description of Artificial Sequence: Synthetic peptide
  C-term amidated
DDPKLYDKDLGSALTDTVVGQVDAATSL

SEQ ID NO: 3112 - protein, 28 aa, Artificial Sequence
  Description of Artificial Sequence: Synthetic peptide
DDPKLYDKDLGSALTDTVVGQVDAATSL

SEQ ID NO: 3113 - protein, 28 aa, Artificial Sequence
  Description of Artificial Sequence: Synthetic peptide
  C-term amidated
DDPKLYDKDLGSALTDTVVGQLDAAWSL

SEQ ID NO: 3114 - protein, 28 aa, Artificial Sequence
  Description of Artificial Sequence: Synthetic peptide
DDPKLYDKDLGSALTDTVVGQLDAAWSL

SEQ ID NO: 3115 - protein, 28 aa, Artificial Sequence
  Description of Artificial Sequence: Synthetic peptide
  C-term amidated
DDPKLYDKDLGSALTDTVVGQLDAATSL

SEQ ID NO: 3116 - protein, 28 aa, Artificial Sequence
  Description of Artificial Sequence: Synthetic peptide
DDPKLYDKDLGSALTDTVVGQLDAATSL

SEQ ID NO: 3117 - protein, 28 aa, Artificial Sequence
  Description of Artificial Sequence: Synthetic peptide
  C-term amidated
DDPKLYDKDLGSALTDTVVGQMDAAWSL

SEQ ID NO: 3118 - protein, 28 aa, Artificial Sequence
  Description of Artificial Sequence: Synthetic peptide
DDPKLYDKDLGSALTDTVVGQMDAAWSL

SEQ ID NO: 3119 - protein, 28 aa, Artificial Sequence
  Description of Artificial Sequence: Synthetic peptide
  C-term amidated
DDPKLYDKDLGSALTDTVVGQMDAATSL

SEQ ID NO: 3120 - protein, 28 aa, Artificial Sequence
  Description of Artificial Sequence: Synthetic peptide
DDPKLYDKDLGSALTDTVVGQMDAATSL

SEQ ID NO: 3121 - protein, 28 aa, Artificial Sequence
  Description of Artificial Sequence: Synthetic peptide
  C-term amidated
DDPKLYDKDLGSALGDWVVAWVDAAWSL

SEQ ID NO: 3122 - protein, 28 aa, Artificial Sequence
  Description of Artificial Sequence: Synthetic peptide
DDPKLYDKDLGSALGDWVVAWVDAAWSL

SEQ ID NO: 3123 - protein, 28 aa, Artificial Sequence
  Description of Artificial Sequence: Synthetic peptide
  C-term amidated
DDPKLYDKDLGSALGDWVVAWVDAATSL

SEQ ID NO: 3124 - protein, 28 aa, Artificial Sequence
  Description of Artificial Sequence: Synthetic peptide
DDPKLYDKDLGSALGDWVVAWVDAATSL

SEQ ID NO: 3125 - protein, 28 aa, Artificial Sequence
  Description of Artificial Sequence: Synthetic peptide
  C-term amidated
DDPKLYDKDLGSALGDWVVAWLDAAWSL

SEQ ID NO: 3126 - protein, 28 aa, Artificial Sequence
  Description of Artificial Sequence: Synthetic peptide
DDPKLYDKDLGSALGDWVVAWLDAAWSL

SEQ ID NO: 3127 - protein, 28 aa, Artificial Sequence
  Description of Artificial Sequence: Synthetic peptide
  C-term amidated
DDPKLYDKDLGSALGDWVVAWLDAATSL

SEQ ID NO: 3128 - protein, 28 aa, Artificial Sequence
  Description of Artificial Sequence: Synthetic peptide
DDPKLYDKDLGSALGDWVVAWLDAATSL

SEQ ID NO: 3129 - protein, 28 aa, Artificial Sequence
  Description of Artificial Sequence: Synthetic peptide
  C-term amidated
DDPKLYDKDLGSALGDWVVAWMDAAWSL

SEQ ID NO: 3130 - protein, 28 aa, Artificial Sequence
  Description of Artificial Sequence: Synthetic peptide
DDPKLYDKDLGSALGDWVVAWMDAAWSL

SEQ ID NO: 3131 - protein, 28 aa, Artificial Sequence
  Description of Artificial Sequence: Synthetic peptide
  C-term amidated
DDPKLYDKDLGSALGDWVVAWMDAATSL

SEQ ID NO: 3132 - protein, 28 aa, Artificial Sequence
  Description of Artificial Sequence: Synthetic peptide
DDPKLYDKDLGSALGDWVVAWMDAATSL

SEQ ID NO: 3133 - protein, 28 aa, Artificial Sequence
  Description of Artificial Sequence: Synthetic peptide
  C-term amidated
DDPKLYDKDLGSALGDWVVAQVDAAWSL

SEQ ID NO: 3134 - protein, 28 aa, Artificial Sequence
  Description of Artificial Sequence: Synthetic peptide
DDPKLYDKDLGSALGDWVVAQVDAAWSL

SEQ ID NO: 3135 - protein, 28 aa, Artificial Sequence
  Description of Artificial Sequence: Synthetic peptide
  C-term amidated
DDPKLYDKDLGSALGDWVVAQVDAATSL

SEQ ID NO: 3136 - protein, 28 aa, Artificial Sequence
  Description of Artificial Sequence: Synthetic peptide
DDPKLYDKDLGSALGDWVVAQVDAATSL

SEQ ID NO: 3137 - protein, 28 aa, Artificial Sequence
  Description of Artificial Sequence: Synthetic peptide
  C-term amidated
DDPKLYDKDLGSALGDWVVAQLDAAWSL

SEQ ID NO: 3138 - protein, 28 aa, Artificial Sequence
  Description of Artificial Sequence: Synthetic peptide
DDPKLYDKDLGSALGDWVVAQLDAAWSL

SEQ ID NO: 3139 - protein, 28 aa, Artificial Sequence
  Description of Artificial Sequence: Synthetic peptide
  C-term amidated
DDPKLYDKDLGSALGDWVVAQLDAATSL

SEQ ID NO: 3140 - protein, 28 aa, Artificial Sequence
  Description of Artificial Sequence: Synthetic peptide
DDPKLYDKDLGSALGDWVVAQLDAATSL

SEQ ID NO: 3141 - protein, 28 aa, Artificial Sequence
  Description of Artificial Sequence: Synthetic peptide
  C-term amidated
DDPKLYDKDLGSALGDWVVAQMDAAWSL

SEQ ID NO: 3142 - protein, 28 aa, Artificial Sequence
  Description of Artificial Sequence: Synthetic peptide
DDPKLYDKDLGSALGDWVVAQMDAAWSL

SEQ ID NO: 3143 - protein, 28 aa, Artificial Sequence
  Description of Artificial Sequence: Synthetic peptide
  C-term amidated
DDPKLYDKDLGSALGDWVVAQMDAATSL

SEQ ID NO: 3144 - protein, 28 aa, Artificial Sequence
  Description of Artificial Sequence: Synthetic peptide
DDPKLYDKDLGSALGDWVVAQMDAATSL

SEQ ID NO: 3145 - protein, 28 aa, Artificial Sequence
  Description of Artificial Sequence: Synthetic peptide
  C-term amidated
DDPKLYDKDLGSALGDWVVGWVDAAWSL

SEQ ID NO: 3146 - protein, 28 aa, Artificial Sequence
  Description of Artificial Sequence: Synthetic peptide
DDPKLYDKDLGSALGDWVVGWVDAAWSL

SEQ ID NO: 3147 - protein, 28 aa, Artificial Sequence
  Description of Artificial Sequence: Synthetic peptide
  C-term amidated
DDPKLYDKDLGSALGDWVVGWVDAATSL

SEQ ID NO: 3148 - protein, 28 aa, Artificial Sequence
  Description of Artificial Sequence: Synthetic peptide
DDPKLYDKDLGSALGDWVVGWVDAATSL

SEQ ID NO: 3149 - protein, 28 aa, Artificial Sequence
  Description of Artificial Sequence: Synthetic peptide
  C-term amidated
DDPKLYDKDLGSALGDWVVGWLDAAWSL

SEQ ID NO: 3150 - protein, 28 aa, Artificial Sequence
  Description of Artificial Sequence: Synthetic peptide
DDPKLYDKDLGSALGDWVVGWLDAAWSL

SEQ ID NO: 3151 - protein, 28 aa, Artificial Sequence
  Description of Artificial Sequence: Synthetic peptide
  C-term amidated
DDPKLYDKDLGSALGDWVVGWLDAATSL

SEQ ID NO: 3152 - protein, 28 aa, Artificial Sequence
  Description of Artificial Sequence: Synthetic peptide
DDPKLYDKDLGSALGDWVVGWLDAATSL

SEQ ID NO: 3153 - protein, 28 aa, Artificial Sequence
  Description of Artificial Sequence: Synthetic peptide
  C-term amidated
DDPKLYDKDLGSALGDWVVGWMDAAWSL

SEQ ID NO: 3154 - protein, 28 aa, Artificial Sequence
  Description of Artificial Sequence: Synthetic peptide
DDPKLYDKDLGSALGDWVVGWMDAAWSL

SEQ ID NO: 3155 - protein, 28 aa, Artificial Sequence
  Description of Artificial Sequence: Synthetic peptide
  C-term amidated
DDPKLYDKDLGSALGDWVVGWMDAATSL

SEQ ID NO: 3156 - protein, 28 aa, Artificial Sequence
  Description of Artificial Sequence: Synthetic peptide
DDPKLYDKDLGSALGDWVVGWMDAATSL

SEQ ID NO: 3157 - protein, 28 aa, Artificial Sequence
  Description of Artificial Sequence: Synthetic peptide
  C-term amidated
DDPKLYDKDLGSALGDWVVGQVDAAWSL

SEQ ID NO: 3158 - protein, 28 aa, Artificial Sequence
  Description of Artificial Sequence: Synthetic peptide
DDPKLYDKDLGSALGDWVVGQVDAAWSL

SEQ ID NO: 3159 - protein, 28 aa, Artificial Sequence
  Description of Artificial Sequence: Synthetic peptide
  C-term amidated
DDPKLYDKDLGSALGDWVVGQVDAATSL

SEQ ID NO: 3160 - protein, 28 aa, Artificial Sequence
  Description of Artificial Sequence: Synthetic peptide
DDPKLYDKDLGSALGDWVVGQVDAATSL

SEQ ID NO: 3161 - protein, 28 aa, Artificial Sequence
  Description of Artificial Sequence: Synthetic peptide
  C-term amidated
DDPKLYDKDLGSALGDWVVGQLDAAWSL

SEQ ID NO: 3162 - protein, 28 aa, Artificial Sequence
  Description of Artificial Sequence: Synthetic peptide
DDPKLYDKDLGSALGDWVVGQLDAAWSL

SEQ ID NO: 3163 - protein, 28 aa, Artificial Sequence
  Description of Artificial Sequence: Synthetic peptide
  C-term amidated
DDPKLYDKDLGSALGDWVVGQLDAATSL

SEQ ID NO: 3164 - protein, 28 aa, Artificial Sequence
  Description of Artificial Sequence: Synthetic peptide
DDPKLYDKDLGSALGDWVVGQLDAATSL

SEQ ID NO: 3165 - protein, 28 aa, Artificial Sequence
  Description of Artificial Sequence: Synthetic peptide
  C-term amidated
DDPKLYDKDLGSALGDWVVGQMDAAWSL

SEQ ID NO: 3166 - protein, 28 aa, Artificial Sequence
  Description of Artificial Sequence: Synthetic peptide
DDPKLYDKDLGSALGDWVVGQMDAAWSL

SEQ ID NO: 3167 - protein, 28 aa, Artificial Sequence
  Description of Artificial Sequence: Synthetic peptide
  C-term amidated
DDPKLYDKDLGSALGDWVVGQMDAATSL

SEQ ID NO: 3168 - protein, 28 aa, Artificial Sequence
  Description of Artificial Sequence: Synthetic peptide
DDPKLYDKDLGSALGDWVVGQMDAATSL

SEQ ID NO: 3169 - protein, 28 aa, Artificial Sequence
  Description of Artificial Sequence: Synthetic peptide
  C-term amidated
DDPKLYDKDLGSALGDTVVAWVDAAWSL

SEQ ID NO: 3170 - protein, 28 aa, Artificial Sequence
  Description of Artificial Sequence: Synthetic peptide
DDPKLYDKDLGSALGDTVVAWVDAAWSL

SEQ ID NO: 3171 - protein, 28 aa, Artificial Sequence
  Description of Artificial Sequence: Synthetic peptide
  C-term amidated
DDPKLYDKDLGSALGDTVVAWVDAATSL

SEQ ID NO: 3172 - protein, 28 aa, Artificial Sequence
  Description of Artificial Sequence: Synthetic peptide
DDPKLYDKDLGSALGDTVVAWVDAATSL

SEQ ID NO: 3173 - protein, 28 aa, Artificial Sequence
  Description of Artificial Sequence: Synthetic peptide
  C-term amidated
DDPKLYDKDLGSALGDTVVAWLDAAWSL

SEQ ID NO: 3174 - protein, 28 aa, Artificial Sequence
  Description of Artificial Sequence: Synthetic peptide
DDPKLYDKDLGSALGDTVVAWLDAAWSL

SEQ ID NO: 3175 - protein, 28 aa, Artificial Sequence
  Description of Artificial Sequence: Synthetic peptide
  C-term amidated
DDPKLYDKDLGSALGDTVVAWLDAATSL

SEQ ID NO: 3176 - protein, 28 aa, Artificial Sequence
  Description of Artificial Sequence: Synthetic peptide
DDPKLYDKDLGSALGDTVVAWLDAATSL

SEQ ID NO: 3177 - protein, 28 aa, Artificial Sequence
  Description of Artificial Sequence: Synthetic peptide
  C-term amidated
DDPKLYDKDLGSALGDTVVAWMDAAWSL

SEQ ID NO: 3178 - protein, 28 aa, Artificial Sequence
  Description of Artificial Sequence: Synthetic peptide
DDPKLYDKDLGSALGDTVVAWMDAAWSL

SEQ ID NO: 3179 - protein, 28 aa, Artificial Sequence
  Description of Artificial Sequence: Synthetic peptide
  C-term amidated
DDPKLYDKDLGSALGDTVVAWMDAATSL

SEQ ID NO: 3180 - protein, 28 aa, Artificial Sequence
  Description of Artificial Sequence: Synthetic peptide
DDPKLYDKDLGSALGDTVVAWMDAATSL

SEQ ID NO: 3181 - protein, 28 aa, Artificial Sequence
  Description of Artificial Sequence: Synthetic peptide
  C-term amidated
DDPKLYDKDLGSALGDTVVAQVDAAWSL

SEQ ID NO: 3182 - protein, 28 aa, Artificial Sequence
  Description of Artificial Sequence: Synthetic peptide
DDPKLYDKDLGSALGDTVVAQVDAAWSL

SEQ ID NO: 3183 - protein, 28 aa, Artificial Sequence
  Description of Artificial Sequence: Synthetic peptide
  C-term amidated
DDPKLYDKDLGSALGDTVVAQVDAATSL

SEQ ID NO: 3184 - protein, 28 aa, Artificial Sequence
  Description of Artificial Sequence: Synthetic peptide
DDPKLYDKDLGSALGDTVVAQVDAATSL

SEQ ID NO: 3185 - protein, 28 aa, Artificial Sequence
  Description of Artificial Sequence: Synthetic peptide
  C-term amidated
DDPKLYDKDLGSALGDTVVAQLDAAWSL

SEQ ID NO: 3186 - protein, 28 aa, Artificial Sequence
  Description of Artificial Sequence: Synthetic peptide
DDPKLYDKDLGSALGDTVVAQLDAAWSL

SEQ ID NO: 3187 - protein, 28 aa, Artificial Sequence
  Description of Artificial Sequence: Synthetic peptide
  C-term amidated
DDPKLYDKDLGSALGDTVVAQLDAATSL

SEQ ID NO: 3188 - protein, 28 aa, Artificial Sequence
  Description of Artificial Sequence: Synthetic peptide
DDPKLYDKDLGSALGDTVVAQLDAATSL

SEQ ID NO: 3189 - protein, 28 aa, Artificial Sequence
  Description of Artificial Sequence: Synthetic peptide
  C-term amidated
DDPKLYDKDLGSALGDTVVAQMDAAWSL

SEQ ID NO: 3190 - protein, 28 aa, Artificial Sequence
  Description of Artificial Sequence: Synthetic peptide
DDPKLYDKDLGSALGDTVVAQMDAAWSL

SEQ ID NO: 3191 - protein, 28 aa, Artificial Sequence
  Description of Artificial Sequence: Synthetic peptide
  C-term amidated
DDPKLYDKDLGSALGDTVVAQMDAATSL

SEQ ID NO: 3192 - protein, 28 aa, Artificial Sequence
  Description of Artificial Sequence: Synthetic peptide
DDPKLYDKDLGSALGDTVVAQMDAATSL

SEQ ID NO: 3193 - protein, 28 aa, Artificial Sequence
  Description of Artificial Sequence: Synthetic peptide
  C-term amidated
DDPKLYDKDLGSALGDTVVGWVDAAWSL

SEQ ID NO: 3194 - protein, 28 aa, Artificial Sequence
  Description of Artificial Sequence: Synthetic peptide
DDPKLYDKDLGSALGDTVVGWVDAAWSL

SEQ ID NO: 3195 - protein, 28 aa, Artificial Sequence
  Description of Artificial Sequence: Synthetic peptide
  C-term amidated
DDPKLYDKDLGSALGDTVVGWVDAATSL

SEQ ID NO: 3196 - protein, 28 aa, Artificial Sequence
  Description of Artificial Sequence: Synthetic peptide
DDPKLYDKDLGSALGDTVVGWVDAATSL

SEQ ID NO: 3197 - protein, 28 aa, Artificial Sequence
  Description of Artificial Sequence: Synthetic peptide
  C-term amidated
DDPKLYDKDLGSALGDTVVGWLDAAWSL

SEQ ID NO: 3198 - protein, 28 aa, Artificial Sequence
  Description of Artificial Sequence: Synthetic peptide
DDPKLYDKDLGSALGDTVVGWLDAAWSL

SEQ ID NO: 3199 - protein, 28 aa, Artificial Sequence
  Description of Artificial Sequence: Synthetic peptide
  C-term amidated
DDPKLYDKDLGSALGDTVVGWLDAATSL

SEQ ID NO: 3200 - protein, 28 aa, Artificial Sequence
  Description of Artificial Sequence: Synthetic peptide
DDPKLYDKDLGSALGDTVVGWLDAATSL

SEQ ID NO: 3201 - protein, 28 aa, Artificial Sequence
  Description of Artificial Sequence: Synthetic peptide
  C-term amidated
DDPKLYDKDLGSALGDTVVGWMDAAWSL

SEQ ID NO: 3202 - protein, 28 aa, Artificial Sequence
  Description of Artificial Sequence: Synthetic peptide
DDPKLYDKDLGSALGDTVVGWMDAAWSL

SEQ ID NO: 3203 - protein, 28 aa, Artificial Sequence
  Description of Artificial Sequence: Synthetic peptide
  C-term amidated
DDPKLYDKDLGSALGDTVVGWMDAATSL

SEQ ID NO: 3204 - protein, 28 aa, Artificial Sequence
  Description of Artificial Sequence: Synthetic peptide
DDPKLYDKDLGSALGDTVVGWMDAATSL

SEQ ID NO: 3205 - protein, 28 aa, Artificial Sequence
  Description of Artificial Sequence: Synthetic peptide
  C-term amidated
DDPKLYDKDLGSALGDTVVGQVDAAWSL

SEQ ID NO: 3206 - protein, 28 aa, Artificial Sequence
  Description of Artificial Sequence: Synthetic peptide
DDPKLYDKDLGSALGDTVVGQVDAAWSL

SEQ ID NO: 3207 - protein, 28 aa, Artificial Sequence
  Description of Artificial Sequence: Synthetic peptide
  C-term amidated
DDPKLYDKDLGSALGDTVVGQVDAATSL

SEQ ID NO: 3208 - protein, 28 aa, Artificial Sequence
  Description of Artificial Sequence: Synthetic peptide
DDPKLYDKDLGSALGDTVVGQVDAATSL

SEQ ID NO: 3209 - protein, 28 aa, Artificial Sequence
  Description of Artificial Sequence: Synthetic peptide
  C-term amidated
DDPKLYDKDLGSALGDTVVGQLDAAWSL

SEQ ID NO: 3210 - protein, 28 aa, Artificial Sequence
  Description of Artificial Sequence: Synthetic peptide
DDPKLYDKDLGSALGDTVVGQLDAAWSL

SEQ ID NO: 3211 - protein, 28 aa, Artificial Sequence
  Description of Artificial Sequence: Synthetic peptide
  C-term amidated
DDPKLYDKDLGSALGDTVVGQLDAATSL

SEQ ID NO: 3212 - protein, 28 aa, Artificial Sequence
  Description of Artificial Sequence: Synthetic peptide
DDPKLYDKDLGSALGDTVVGQLDAATSL

SEQ ID NO: 3213 - protein, 28 aa, Artificial Sequence
  Description of Artificial Sequence: Synthetic peptide
  C-term amidated
DDPKLYDKDLGSALGDTVVGQMDAAWSL

SEQ ID NO: 3214 - protein, 28 aa, Artificial Sequence
  Description of Artificial Sequence: Synthetic peptide
DDPKLYDKDLGSALGDTVVGQMDAAWSL

SEQ ID NO: 3215 - protein, 28 aa, Artificial Sequence
  Description of Artificial Sequence: Synthetic peptide
  C-term amidated
DDPKLYDKDLGSALGDTVVGQMDAATSL

SEQ ID NO: 3216 - protein, 28 aa, Artificial Sequence
  Description of Artificial Sequence: Synthetic peptide
DDPKLYDKDLGSALGDTVVGQMDAATSL

SEQ ID NO: 3217 - protein, 28 aa, Artificial Sequence
  Description of Artificial Sequence: Synthetic peptide
  C-term amidated
DDPKLYDKDLGSAMWDWVVAWVDAAWSL

SEQ ID NO: 3218 - protein, 28 aa, Artificial Sequence
  Description of Artificial Sequence: Synthetic peptide
DDPKLYDKDLGSAMWDWVVAWVDAAWSL

SEQ ID NO: 3219 - protein, 28 aa, Artificial Sequence
  Description of Artificial Sequence: Synthetic peptide
  C-term amidated
DDPKLYDKDLGSAMWDWVVAWVDAATSL

SEQ ID NO: 3220 - protein, 28 aa, Artificial Sequence
  Description of Artificial Sequence: Synthetic peptide
DDPKLYDKDLGSAMWDWVVAWVDAATSL

SEQ ID NO: 3221 - protein, 28 aa, Artificial Sequence
  Description of Artificial Sequence: Synthetic peptide
  C-term amidated
DDPKLYDKDLGSAMWDWVVAWLDAAWSL

SEQ ID NO: 3222 - protein, 28 aa, Artificial Sequence
  Description of Artificial Sequence: Synthetic peptide
DDPKLYDKDLGSAMWDWVVAWLDAAWSL

SEQ ID NO: 3223 - protein, 28 aa, Artificial Sequence
  Description of Artificial Sequence: Synthetic peptide
  C-term amidated
DDPKLYDKDLGSAMWDWVVAWLDAATSL

SEQ ID NO: 3224 - protein, 28 aa, Artificial Sequence
  Description of Artificial Sequence: Synthetic peptide
DDPKLYDKDLGSAMWDWVVAWLDAATSL

SEQ ID NO: 3225 - protein, 28 aa, Artificial Sequence
  Description of Artificial Sequence: Synthetic peptide
  C-term amidated
DDPKLYDKDLGSAMWDWVVAWMDAAWSL

SEQ ID NO: 3226 - protein, 28 aa, Artificial Sequence
  Description of Artificial Sequence: Synthetic peptide
DDPKLYDKDLGSAMWDWVVAWMDAAWSL

SEQ ID NO: 3227 - protein, 28 aa, Artificial Sequence
  Description of Artificial Sequence: Synthetic peptide
  C-term amidated
DDPKLYDKDLGSAMWDWVVAWMDAATSL

SEQ ID NO: 3228 - protein, 28 aa, Artificial Sequence
  Description of Artificial Sequence: Synthetic peptide
DDPKLYDKDLGSAMWDWVVAWMDAATSL

SEQ ID NO: 3229 - protein, 28 aa, Artificial Sequence
  Description of Artificial Sequence: Synthetic peptide
  C-term amidated
DDPKLYDKDLGSAMWDWVVAQVDAAWSL

SEQ ID NO: 3230 - protein, 28 aa, Artificial Sequence
  Description of Artificial Sequence: Synthetic peptide
DDPKLYDKDLGSAMWDWVVAQVDAAWSL

SEQ ID NO: 3231 - protein, 28 aa, Artificial Sequence
  Description of Artificial Sequence: Synthetic peptide
  C-term amidated
DDPKLYDKDLGSAMWDWVVAQVDAATSL

SEQ ID NO: 3232 - protein, 28 aa, Artificial Sequence
  Description of Artificial Sequence: Synthetic peptide
DDPKLYDKDLGSAMWDWVVAQVDAATSL

SEQ ID NO: 3233 - protein, 28 aa, Artificial Sequence
  Description of Artificial Sequence: Synthetic peptide
  C-term amidated
DDPKLYDKDLGSAMWDWVVAQLDAAWSL

SEQ ID NO: 3234 - protein, 28 aa, Artificial Sequence
  Description of Artificial Sequence: Synthetic peptide
DDPKLYDKDLGSAMWDWVVAQLDAAWSL

SEQ ID NO: 3235 - protein, 28 aa, Artificial Sequence
  Description of Artificial Sequence: Synthetic peptide
  C-term amidated
DDPKLYDKDLGSAMWDWVVAQLDAATSL

SEQ ID NO: 3236 - protein, 28 aa, Artificial Sequence
  Description of Artificial Sequence: Synthetic peptide
DDPKLYDKDLGSAMWDWVVAQLDAATSL

SEQ ID NO: 3237 - protein, 28 aa, Artificial Sequence
  Description of Artificial Sequence: Synthetic peptide
  C-term amidated
DDPKLYDKDLGSAMWDWVVAQMDAAWSL

SEQ ID NO: 3238 - protein, 28 aa, Artificial Sequence
  Description of Artificial Sequence: Synthetic peptide
DDPKLYDKDLGSAMWDWVVAQMDAAWSL

SEQ ID NO: 3239 - protein, 28 aa, Artificial Sequence
  Description of Artificial Sequence: Synthetic peptide
  C-term amidated
DDPKLYDKDLGSAMWDWVVAQMDAATSL

SEQ ID NO: 3240 - protein, 28 aa, Artificial Sequence
  Description of Artificial Sequence: Synthetic peptide
DDPKLYDKDLGSAMWDWVVAQMDAATSL

SEQ ID NO: 3241 - protein, 28 aa, Artificial Sequence
  Description of Artificial Sequence: Synthetic peptide
  C-term amidated
DDPKLYDKDLGSAMWDWVVGWVDAAWSL

SEQ ID NO: 3242 - protein, 28 aa, Artificial Sequence
  Description of Artificial Sequence: Synthetic peptide
DDPKLYDKDLGSAMWDWVVGWVDAAWSL

SEQ ID NO: 3243 - protein, 28 aa, Artificial Sequence
  Description of Artificial Sequence: Synthetic peptide
  C-term amidated
DDPKLYDKDLGSAMWDWVVGWVDAATSL

SEQ ID NO: 3244 - protein, 28 aa, Artificial Sequence
  Description of Artificial Sequence: Synthetic peptide
DDPKLYDKDLGSAMWDWVVGWVDAATSL

SEQ ID NO: 3245 - protein, 28 aa, Artificial Sequence
  Description of Artificial Sequence: Synthetic peptide
  C-term amidated
DDPKLYDKDLGSAMWDWVVGWLDAAWSL

SEQ ID NO: 3246 - protein, 28 aa, Artificial Sequence
  Description of Artificial Sequence: Synthetic peptide
DDPKLYDKDLGSAMWDWVVGWLDAAWSL

SEQ ID NO: 3247 - protein, 28 aa, Artificial Sequence
  Description of Artificial Sequence: Synthetic peptide
  C-term amidated
DDPKLYDKDLGSAMWDWVVGWLDAATSL

SEQ ID NO: 3248 - protein, 28 aa, Artificial Sequence
  Description of Artificial Sequence: Synthetic peptide
DDPKLYDKDLGSAMWDWVVGWLDAATSL

SEQ ID NO: 3249 - protein, 28 aa, Artificial Sequence
  Description of Artificial Sequence: Synthetic peptide
  C-term amidated
DDPKLYDKDLGSAMWDWVVGWMDAAWSL

SEQ ID NO: 3250 - protein, 28 aa, Artificial Sequence
  Description of Artificial Sequence: Synthetic peptide
DDPKLYDKDLGSAMWDWVVGWMDAAWSL

SEQ ID NO: 3251 - protein, 28 aa, Artificial Sequence
  Description of Artificial Sequence: Synthetic peptide
  C-term amidated
DDPKLYDKDLGSAMWDWVVGWMDAATSL

SEQ ID NO: 3252 - protein, 28 aa, Artificial Sequence
  Description of Artificial Sequence: Synthetic peptide
DDPKLYDKDLGSAMWDWVVGWMDAATSL

SEQ ID NO: 3253 - protein, 28 aa, Artificial Sequence
  Description of Artificial Sequence: Synthetic peptide
  C-term amidated
DDPKLYDKDLGSAMWDWVVGQVDAAWSL

SEQ ID NO: 3254 - protein, 28 aa, Artificial Sequence
  Description of Artificial Sequence: Synthetic peptide
DDPKLYDKDLGSAMWDWVVGQVDAAWSL

SEQ ID NO: 3255 - protein, 28 aa, Artificial Sequence
  Description of Artificial Sequence: Synthetic peptide
  C-term amidated
DDPKLYDKDLGSAMWDWVVGQVDAATSL

SEQ ID NO: 3256 - protein, 28 aa, Artificial Sequence
  Description of Artificial Sequence: Synthetic peptide
DDPKLYDKDLGSAMWDWVVGQVDAATSL

SEQ ID NO: 3257 - protein, 28 aa, Artificial Sequence
  Description of Artificial Sequence: Synthetic peptide
  C-term amidated
DDPKLYDKDLGSAMWDWVVGQLDAAWSL

SEQ ID NO: 3258 - protein, 28 aa, Artificial Sequence
  Description of Artificial Sequence: Synthetic peptide
DDPKLYDKDLGSAMWDWVVGQLDAAWSL

SEQ ID NO: 3259 - protein, 28 aa, Artificial Sequence
  Description of Artificial Sequence: Synthetic peptide
  C-term amidated
DDPKLYDKDLGSAMWDWVVGQLDAATSL

SEQ ID NO: 3260 - protein, 28 aa, Artificial Sequence
  Description of Artificial Sequence: Synthetic peptide
DDPKLYDKDLGSAMWDWVVGQLDAATSL

SEQ ID NO: 3261 - protein, 28 aa, Artificial Sequence
  Description of Artificial Sequence: Synthetic peptide
  C-term amidated
DDPKLYDKDLGSAMWDWVVGQMDAAWSL

SEQ ID NO: 3262 - protein, 28 aa, Artificial Sequence
  Description of Artificial Sequence: Synthetic peptide
DDPKLYDKDLGSAMWDWVVGQMDAAWSL

SEQ ID NO: 3263 - protein, 28 aa, Artificial Sequence
  Description of Artificial Sequence: Synthetic peptide
  C-term amidated
DDPKLYDKDLGSAMWDWVVGQMDAATSL

SEQ ID NO: 3264 - protein, 28 aa, Artificial Sequence
  Description of Artificial Sequence: Synthetic peptide
DDPKLYDKDLGSAMWDWVVGQMDAATSL

SEQ ID NO: 3265 - protein, 28 aa, Artificial Sequence
  Description of Artificial Sequence: Synthetic peptide
  C-term amidated
DDPKLYDKDLGSAMWDTVVAWVDAAWSL

SEQ ID NO: 3266 - protein, 28 aa, Artificial Sequence
  Description of Artificial Sequence: Synthetic peptide
DDPKLYDKDLGSAMWDTVVAWVDAAWSL

SEQ ID NO: 3267 - protein, 28 aa, Artificial Sequence
  Description of Artificial Sequence: Synthetic peptide
  C-term amidated
DDPKLYDKDLGSAMWDTVVAWVDAATSL

SEQ ID NO: 3268 - protein, 28 aa, Artificial Sequence
  Description of Artificial Sequence: Synthetic peptide
DDPKLYDKDLGSAMWDTVVAWVDAATSL

SEQ ID NO: 3269 - protein, 28 aa, Artificial Sequence
  Description of Artificial Sequence: Synthetic peptide
  C-term amidated
DDPKLYDKDLGSAMWDTVVAWLDAAWSL

SEQ ID NO: 3270 - protein, 28 aa, Artificial Sequence
  Description of Artificial Sequence: Synthetic peptide
DDPKLYDKDLGSAMWDTVVAWLDAAWSL

SEQ ID NO: 3271 - protein, 28 aa, Artificial Sequence
  Description of Artificial Sequence: Synthetic peptide
  C-term amidated
DDPKLYDKDLGSAMWDTVVAWLDAATSL

SEQ ID NO: 3272 - protein, 28 aa, Artificial Sequence
  Description of Artificial Sequence: Synthetic peptide
DDPKLYDKDLGSAMWDTVVAWLDAATSL

SEQ ID NO: 3273 - protein, 28 aa, Artificial Sequence
  Description of Artificial Sequence: Synthetic peptide
  C-term amidated
DDPKLYDKDLGSAMWDTVVAWMDAAWSL

SEQ ID NO: 3274 - protein, 28 aa, Artificial Sequence
  Description of Artificial Sequence: Synthetic peptide
DDPKLYDKDLGSAMWDTVVAWMDAAWSL

SEQ ID NO: 3275 - protein, 28 aa, Artificial Sequence
  Description of Artificial Sequence: Synthetic peptide
  C-term amidated
DDPKLYDKDLGSAMWDTVVAWMDAATSL

SEQ ID NO: 3276 - protein, 28 aa, Artificial Sequence
  Description of Artificial Sequence: Synthetic peptide
DDPKLYDKDLGSAMWDTVVAWMDAATSL

SEQ ID NO: 3277 - protein, 28 aa, Artificial Sequence
  Description of Artificial Sequence: Synthetic peptide
  C-term amidated
DDPKLYDKDLGSAMWDTVVAQVDAAWSL

SEQ ID NO: 3278 - protein, 28 aa, Artificial Sequence
  Description of Artificial Sequence: Synthetic peptide
DDPKLYDKDLGSAMWDTVVAQVDAAWSL

SEQ ID NO: 3279 - protein, 28 aa, Artificial Sequence
  Description of Artificial Sequence: Synthetic peptide
  C-term amidated
DDPKLYDKDLGSAMWDTVVAQVDAATSL

SEQ ID NO: 3280 - protein, 28 aa, Artificial Sequence
  Description of Artificial Sequence: Synthetic peptide
DDPKLYDKDLGSAMWDTVVAQVDAATSL

SEQ ID NO: 3281 - protein, 28 aa, Artificial Sequence
  Description of Artificial Sequence: Synthetic peptide
  C-term amidated
DDPKLYDKDLGSAMWDTVVAQLDAAWSL

SEQ ID NO: 3282 - protein, 28 aa, Artificial Sequence
  Description of Artificial Sequence: Synthetic peptide
DDPKLYDKDLGSAMWDTVVAQLDAAWSL

SEQ ID NO: 3283 - protein, 28 aa, Artificial Sequence
  Description of Artificial Sequence: Synthetic peptide
  C-term amidated
DDPKLYDKDLGSAMWDTVVAQLDAATSL

SEQ ID NO: 3284 - protein, 28 aa, Artificial Sequence
  Description of Artificial Sequence: Synthetic peptide
DDPKLYDKDLGSAMWDTVVAQLDAATSL

SEQ ID NO: 3285 - protein, 28 aa, Artificial Sequence
  Description of Artificial Sequence: Synthetic peptide
  C-term amidated
DDPKLYDKDLGSAMWDTVVAQMDAAWSL

SEQ ID NO: 3286 - protein, 28 aa, Artificial Sequence
  Description of Artificial Sequence: Synthetic peptide
DDPKLYDKDLGSAMWDTVVAQMDAAWSL

SEQ ID NO: 3287 - protein, 28 aa, Artificial Sequence
  Description of Artificial Sequence: Synthetic peptide
  C-term amidated
DDPKLYDKDLGSAMWDTVVAQMDAATSL

SEQ ID NO: 3288 - protein, 28 aa, Artificial Sequence
  Description of Artificial Sequence: Synthetic peptide
DDPKLYDKDLGSAMWDTVVAQMDAATSL

SEQ ID NO: 3289 - protein, 28 aa, Artificial Sequence
  Description of Artificial Sequence: Synthetic peptide
  C-term amidated
DDPKLYDKDLGSAMWDTVVGWVDAAWSL

SEQ ID NO: 3290 - protein, 28 aa, Artificial Sequence
  Description of Artificial Sequence: Synthetic peptide
DDPKLYDKDLGSAMWDTVVGWVDAAWSL

SEQ ID NO: 3291 - protein, 28 aa, Artificial Sequence
  Description of Artificial Sequence: Synthetic peptide
  C-term amidated
DDPKLYDKDLGSAMWDTVVGWVDAATSL

SEQ ID NO: 3292 - protein, 28 aa, Artificial Sequence
  Description of Artificial Sequence: Synthetic peptide
DDPKLYDKDLGSAMWDTVVGWVDAATSL

SEQ ID NO: 3293 - protein, 28 aa, Artificial Sequence
  Description of Artificial Sequence: Synthetic peptide
  C-term amidated
DDPKLYDKDLGSAMWDTVVGWLDAAWSL

SEQ ID NO: 3294 - protein, 28 aa, Artificial Sequence
  Description of Artificial Sequence: Synthetic peptide
DDPKLYDKDLGSAMWDTVVGWLDAAWSL

SEQ ID NO: 3295 - protein, 28 aa, Artificial Sequence
  Description of Artificial Sequence: Synthetic peptide
  C-term amidated
DDPKLYDKDLGSAMWDTVVGWLDAATSL

SEQ ID NO: 3296 - protein, 28 aa, Artificial Sequence
  Description of Artificial Sequence: Synthetic peptide
DDPKLYDKDLGSAMWDTVVGWLDAATSL

SEQ ID NO: 3297 - protein, 28 aa, Artificial Sequence
  Description of Artificial Sequence: Synthetic peptide
  C-term amidated
DDPKLYDKDLGSAMWDTVVGWMDAAWSL

SEQ ID NO: 3298 - protein, 28 aa, Artificial Sequence
  Description of Artificial Sequence: Synthetic peptide
DDPKLYDKDLGSAMWDTVVGWMDAAWSL

SEQ ID NO: 3299 - protein, 28 aa, Artificial Sequence
  Description of Artificial Sequence: Synthetic peptide
  C-term amidated
DDPKLYDKDLGSAMWDTVVGWMDAATSL

SEQ ID NO: 3300 - protein, 28 aa, Artificial Sequence
  Description of Artificial Sequence: Synthetic peptide
DDPKLYDKDLGSAMWDTVVGWMDAATSL

SEQ ID NO: 3301 - protein, 28 aa, Artificial Sequence
  Description of Artificial Sequence: Synthetic peptide
  C-term amidated
DDPKLYDKDLGSAMWDTVVGQVDAAWSL

SEQ ID NO: 3302 - protein, 28 aa, Artificial Sequence
  Description of Artificial Sequence: Synthetic peptide
DDPKLYDKDLGSAMWDTVVGQVDAAWSL

SEQ ID NO: 3303 - protein, 28 aa, Artificial Sequence
  Description of Artificial Sequence: Synthetic peptide
  C-term amidated
DDPKLYDKDLGSAMWDTVVGQVDAATSL

SEQ ID NO: 3304 - protein, 28 aa, Artificial Sequence
  Description of Artificial Sequence: Synthetic peptide
DDPKLYDKDLGSAMWDTVVGQVDAATSL

SEQ ID NO: 3305 - protein, 28 aa, Artificial Sequence
  Description of Artificial Sequence: Synthetic peptide
  C-term amidated
DDPKLYDKDLGSAMWDTVVGQLDAAWSL

SEQ ID NO: 3306 - protein, 28 aa, Artificial Sequence
  Description of Artificial Sequence: Synthetic peptide
DDPKLYDKDLGSAMWDTVVGQLDAAWSL

SEQ ID NO: 3307 - protein, 28 aa, Artificial Sequence
  Description of Artificial Sequence: Synthetic peptide
  C-term amidated
DDPKLYDKDLGSAMWDTVVGQLDAATSL

SEQ ID NO: 3308 - protein, 28 aa, Artificial Sequence
  Description of Artificial Sequence: Synthetic peptide
DDPKLYDKDLGSAMWDTVVGQLDAATSL

SEQ ID NO: 3309 - protein, 28 aa, Artificial Sequence
  Description of Artificial Sequence: Synthetic peptide
  C-term amidated
DDPKLYDKDLGSAMWDTVVGQMDAAWSL

SEQ ID NO: 3310 - protein, 28 aa, Artificial Sequence
  Description of Artificial Sequence: Synthetic peptide
DDPKLYDKDLGSAMWDTVVGQMDAAWSL

SEQ ID NO: 3311 - protein, 28 aa, Artificial Sequence
  Description of Artificial Sequence: Synthetic peptide
  C-term amidated
DDPKLYDKDLGSAMWDTVVGQMDAATSL

SEQ ID NO: 3312 - protein, 28 aa, Artificial Sequence
  Description of Artificial Sequence: Synthetic peptide
DDPKLYDKDLGSAMWDTVVGQMDAATSL

SEQ ID NO: 3313 - protein, 28 aa, Artificial Sequence
  Description of Artificial Sequence: Synthetic peptide
  C-term amidated
DDPKLYDKDLGSAMTDWVVAWVDAAWSL

SEQ ID NO: 3314 - protein, 28 aa, Artificial Sequence
  Description of Artificial Sequence: Synthetic peptide
DDPKLYDKDLGSAMTDWVVAWVDAAWSL

SEQ ID NO: 3315 - protein, 28 aa, Artificial Sequence
  Description of Artificial Sequence: Synthetic peptide
  C-term amidated
DDPKLYDKDLGSAMTDWVVAWVDAATSL

SEQ ID NO: 3316 - protein, 28 aa, Artificial Sequence
  Description of Artificial Sequence: Synthetic peptide
DDPKLYDKDLGSAMTDWVVAWVDAATSL

SEQ ID NO: 3317 - protein, 28 aa, Artificial Sequence
  Description of Artificial Sequence: Synthetic peptide
  C-term amidated
DDPKLYDKDLGSAMTDWVVAWLDAAWSL

SEQ ID NO: 3318 - protein, 28 aa, Artificial Sequence
  Description of Artificial Sequence: Synthetic peptide
DDPKLYDKDLGSAMTDWVVAWLDAAWSL

SEQ ID NO: 3319 - protein, 28 aa, Artificial Sequence
  Description of Artificial Sequence: Synthetic peptide
  C-term amidated
DDPKLYDKDLGSAMTDWVVAWLDAATSL

SEQ ID NO: 3320 - protein, 28 aa, Artificial Sequence
  Description of Artificial Sequence: Synthetic peptide
DDPKLYDKDLGSAMTDWVVAWLDAATSL

SEQ ID NO: 3321 - protein, 28 aa, Artificial Sequence
  Description of Artificial Sequence: Synthetic peptide
  C-term amidated
DDPKLYDKDLGSAMTDWVVAWMDAAWSL

SEQ ID NO: 3322 - protein, 28 aa, Artificial Sequence
  Description of Artificial Sequence: Synthetic peptide
DDPKLYDKDLGSAMTDWVVAWMDAAWSL

SEQ ID NO: 3323 - protein, 28 aa, Artificial Sequence
  Description of Artificial Sequence: Synthetic peptide
  C-term amidated
DDPKLYDKDLGSAMTDWVVAWMDAATSL

SEQ ID NO: 3324 - protein, 28 aa, Artificial Sequence
  Description of Artificial Sequence: Synthetic peptide
DDPKLYDKDLGSAMTDWVVAWMDAATSL

SEQ ID NO: 3325 - protein, 28 aa, Artificial Sequence
  Description of Artificial Sequence: Synthetic peptide
  C-term amidated
DDPKLYDKDLGSAMTDWVVAQVDAAWSL

SEQ ID NO: 3326 - protein, 28 aa, Artificial Sequence
  Description of Artificial Sequence: Synthetic peptide
DDPKLYDKDLGSAMTDWVVAQVDAAWSL

SEQ ID NO: 3327 - protein, 28 aa, Artificial Sequence
  Description of Artificial Sequence: Synthetic peptide
  C-term amidated
DDPKLYDKDLGSAMTDWVVAQVDAATSL

SEQ ID NO: 3328 - protein, 28 aa, Artificial Sequence
  Description of Artificial Sequence: Synthetic peptide
DDPKLYDKDLGSAMTDWVVAQVDAATSL

SEQ ID NO: 3329 - protein, 28 aa, Artificial Sequence
  Description of Artificial Sequence: Synthetic peptide
  C-term amidated
DDPKLYDKDLGSAMTDWVVAQLDAAWSL

SEQ ID NO: 3330 - protein, 28 aa, Artificial Sequence
  Description of Artificial Sequence: Synthetic peptide
DDPKLYDKDLGSAMTDWVVAQLDAAWSL

SEQ ID NO: 3331 - protein, 28 aa, Artificial Sequence
  Description of Artificial Sequence: Synthetic peptide
  C-term amidated
DDPKLYDKDLGSAMTDWVVAQLDAATSL

SEQ ID NO: 3332 - protein, 28 aa, Artificial Sequence
  Description of Artificial Sequence: Synthetic peptide
DDPKLYDKDLGSAMTDWVVAQLDAATSL

SEQ ID NO: 3333 - protein, 28 aa, Artificial Sequence
  Description of Artificial Sequence: Synthetic peptide
  C-term amidated
DDPKLYDKDLGSAMTDWVVAQMDAAWSL

SEQ ID NO: 3334 - protein, 28 aa, Artificial Sequence
  Description of Artificial Sequence: Synthetic peptide
DDPKLYDKDLGSAMTDWVVAQMDAAWSL

SEQ ID NO: 3335 - protein, 28 aa, Artificial Sequence
  Description of Artificial Sequence: Synthetic peptide
  C-term amidated
DDPKLYDKDLGSAMTDWVVAQMDAATSL

SEQ ID NO: 3336 - protein, 28 aa, Artificial Sequence
  Description of Artificial Sequence: Synthetic peptide
DDPKLYDKDLGSAMTDWVVAQMDAATSL

SEQ ID NO: 3337 - protein, 28 aa, Artificial Sequence
  Description of Artificial Sequence: Synthetic peptide
  C-term amidated
DDPKLYDKDLGSAMTDWVVGWVDAAWSL

SEQ ID NO: 3338 - protein, 28 aa, Artificial Sequence
  Description of Artificial Sequence: Synthetic peptide
DDPKLYDKDLGSAMTDWVVGWVDAAWSL

SEQ ID NO: 3339 - protein, 28 aa, Artificial Sequence
  Description of Artificial Sequence: Synthetic peptide
  C-term amidated
DDPKLYDKDLGSAMTDWVVGWVDAATSL

SEQ ID NO: 3340 - protein, 28 aa, Artificial Sequence
  Description of Artificial Sequence: Synthetic peptide
DDPKLYDKDLGSAMTDWVVGWVDAATSL

SEQ ID NO: 3341 - protein, 28 aa, Artificial Sequence
  Description of Artificial Sequence: Synthetic peptide
  C-term amidated
DDPKLYDKDLGSAMTDWVVGWLDAAWSL

SEQ ID NO: 3342 - protein, 28 aa, Artificial Sequence
  Description of Artificial Sequence: Synthetic peptide
DDPKLYDKDLGSAMTDWVVGWLDAAWSL

SEQ ID NO: 3343 - protein, 28 aa, Artificial Sequence
  Description of Artificial Sequence: Synthetic peptide
  C-term amidated
DDPKLYDKDLGSAMTDWVVGWLDAATSL

SEQ ID NO: 3344 - protein, 28 aa, Artificial Sequence
  Description of Artificial Sequence: Synthetic peptide
DDPKLYDKDLGSAMTDWVVGWLDAATSL

SEQ ID NO: 3345 - protein, 28 aa, Artificial Sequence
  Description of Artificial Sequence: Synthetic peptide
  C-term amidated
DDPKLYDKDLGSAMTDWVVGWMDAAWSL

SEQ ID NO: 3346 - protein, 28 aa, Artificial Sequence
  Description of Artificial Sequence: Synthetic peptide
DDPKLYDKDLGSAMTDWVVGWMDAAWSL

SEQ ID NO: 3347 - protein, 28 aa, Artificial Sequence
  Description of Artificial Sequence: Synthetic peptide
  C-term amidated
DDPKLYDKDLGSAMTDWVVGWMDAATSL

SEQ ID NO: 3348 - protein, 28 aa, Artificial Sequence
  Description of Artificial Sequence: Synthetic peptide
DDPKLYDKDLGSAMTDWVVGWMDAATSL

SEQ ID NO: 3349 - protein, 28 aa, Artificial Sequence
  Description of Artificial Sequence: Synthetic peptide
  C-term amidated
DDPKLYDKDLGSAMTDWVVGQVDAAWSL

SEQ ID NO: 3350 - protein, 28 aa, Artificial Sequence
  Description of Artificial Sequence: Synthetic peptide
DDPKLYDKDLGSAMTDWVVGQVDAAWSL

SEQ ID NO: 3351 - protein, 28 aa, Artificial Sequence
  Description of Artificial Sequence: Synthetic peptide
  C-term amidated
DDPKLYDKDLGSAMTDWVVGQVDAATSL

SEQ ID NO: 3352 - protein, 28 aa, Artificial Sequence
  Description of Artificial Sequence: Synthetic peptide
DDPKLYDKDLGSAMTDWVVGQVDAATSL

SEQ ID NO: 3353 - protein, 28 aa, Artificial Sequence
  Description of Artificial Sequence: Synthetic peptide
  C-term amidated
DDPKLYDKDLGSAMTDWVVGQLDAAWSL

SEQ ID NO: 3354 - protein, 28 aa, Artificial Sequence
  Description of Artificial Sequence: Synthetic peptide
DDPKLYDKDLGSAMTDWVVGQLDAAWSL

SEQ ID NO: 3355 - protein, 28 aa, Artificial Sequence
  Description of Artificial Sequence: Synthetic peptide
  C-term amidated
DDPKLYDKDLGSAMTDWVVGQLDAATSL

SEQ ID NO: 3356 - protein, 28 aa, Artificial Sequence
  Description of Artificial Sequence: Synthetic peptide
DDPKLYDKDLGSAMTDWVVGQLDAATSL

SEQ ID NO: 3357 - protein, 28 aa, Artificial Sequence
  Description of Artificial Sequence: Synthetic peptide
  C-term amidated
DDPKLYDKDLGSAMTDWVVGQMDAAWSL

SEQ ID NO: 3358 - protein, 28 aa, Artificial Sequence
  Description of Artificial Sequence: Synthetic peptide
DDPKLYDKDLGSAMTDWVVGQMDAAWSL

SEQ ID NO: 3359 - protein, 28 aa, Artificial Sequence
  Description of Artificial Sequence: Synthetic peptide
  C-term amidated
DDPKLYDKDLGSAMTDWVVGQMDAATSL

SEQ ID NO: 3360 - protein, 28 aa, Artificial Sequence
  Description of Artificial Sequence: Synthetic peptide
DDPKLYDKDLGSAMTDWVVGQMDAATSL

SEQ ID NO: 3361 - protein, 28 aa, Artificial Sequence
  Description of Artificial Sequence: Synthetic peptide
  C-term amidated
DDPKLYDKDLGSAMTDTVVAWVDAAWSL

SEQ ID NO: 3362 - protein, 28 aa, Artificial Sequence
  Description of Artificial Sequence: Synthetic peptide
DDPKLYDKDLGSAMTDTVVAWVDAAWSL

SEQ ID NO: 3363 - protein, 28 aa, Artificial Sequence
  Description of Artificial Sequence: Synthetic peptide
  C-term amidated
DDPKLYDKDLGSAMTDTVVAWVDAATSL

SEQ ID NO: 3364 - protein, 28 aa, Artificial Sequence
  Description of Artificial Sequence: Synthetic peptide
DDPKLYDKDLGSAMTDTVVAWVDAATSL

SEQ ID NO: 3365 - protein, 28 aa, Artificial Sequence
  Description of Artificial Sequence: Synthetic peptide
  C-term amidated
DDPKLYDKDLGSAMTDTVVAWLDAAWSL

SEQ ID NO: 3366 - protein, 28 aa, Artificial Sequence
  Description of Artificial Sequence: Synthetic peptide
DDPKLYDKDLGSAMTDTVVAWLDAAWSL

SEQ ID NO: 3367 - protein, 28 aa, Artificial Sequence
  Description of Artificial Sequence: Synthetic peptide
  C-term amidated
DDPKLYDKDLGSAMTDTVVAWLDAATSL

SEQ ID NO: 3368 - protein, 28 aa, Artificial Sequence
  Description of Artificial Sequence: Synthetic peptide
DDPKLYDKDLGSAMTDTVVAWLDAATSL

SEQ ID NO: 3369 - protein, 28 aa, Artificial Sequence
  Description of Artificial Sequence: Synthetic peptide
  C-term amidated
DDPKLYDKDLGSAMTDTVVAWMDAAWSL

SEQ ID NO: 3370 - protein, 28 aa, Artificial Sequence
  Description of Artificial Sequence: Synthetic peptide
DDPKLYDKDLGSAMTDTVVAWMDAAWSL

SEQ ID NO: 3371 - protein, 28 aa, Artificial Sequence
  Description of Artificial Sequence: Synthetic peptide
  C-term amidated
DDPKLYDKDLGSAMTDTVVAWMDAATSL

SEQ ID NO: 3372 - protein, 28 aa, Artificial Sequence
  Description of Artificial Sequence: Synthetic peptide
DDPKLYDKDLGSAMTDTVVAWMDAATSL

SEQ ID NO: 3373 - protein, 28 aa, Artificial Sequence
  Description of Artificial Sequence: Synthetic peptide
  C-term amidated
DDPKLYDKDLGSAMTDTVVAQVDAAWSL

SEQ ID NO: 3374 - protein, 28 aa, Artificial Sequence
  Description of Artificial Sequence: Synthetic peptide
DDPKLYDKDLGSAMTDTVVAQVDAAWSL

SEQ ID NO: 3375 - protein, 28 aa, Artificial Sequence
  Description of Artificial Sequence: Synthetic peptide
  C-term amidated
DDPKLYDKDLGSAMTDTVVAQVDAATSL

SEQ ID NO: 3376 - protein, 28 aa, Artificial Sequence
  Description of Artificial Sequence: Synthetic peptide
DDPKLYDKDLGSAMTDTVVAQVDAATSL

SEQ ID NO: 3377 - protein, 28 aa, Artificial Sequence
  Description of Artificial Sequence: Synthetic peptide
  C-term amidated
DDPKLYDKDLGSAMTDTVVAQLDAAWSL

SEQ ID NO: 3378 - protein, 28 aa, Artificial Sequence
  Description of Artificial Sequence: Synthetic peptide
DDPKLYDKDLGSAMTDTVVAQLDAAWSL

SEQ ID NO: 3379 - protein, 28 aa, Artificial Sequence
  Description of Artificial Sequence: Synthetic peptide
  C-term amidated
DDPKLYDKDLGSAMTDTVVAQLDAATSL

SEQ ID NO: 3380 - protein, 28 aa, Artificial Sequence
  Description of Artificial Sequence: Synthetic peptide
DDPKLYDKDLGSAMTDTVVAQLDAATSL

SEQ ID NO: 3381 - protein, 28 aa, Artificial Sequence
  Description of Artificial Sequence: Synthetic peptide
  C-term amidated
DDPKLYDKDLGSAMTDTVVAQMDAAWSL

SEQ ID NO: 3382 - protein, 28 aa, Artificial Sequence
  Description of Artificial Sequence: Synthetic peptide
DDPKLYDKDLGSAMTDTVVAQMDAAWSL

SEQ ID NO: 3383 - protein, 28 aa, Artificial Sequence
  Description of Artificial Sequence: Synthetic peptide
  C-term amidated
DDPKLYDKDLGSAMTDTVVAQMDAATSL

SEQ ID NO: 3384 - protein, 28 aa, Artificial Sequence
  Description of Artificial Sequence: Synthetic peptide
DDPKLYDKDLGSAMTDTVVAQMDAATSL

SEQ ID NO: 3385 - protein, 28 aa, Artificial Sequence
  Description of Artificial Sequence: Synthetic peptide
  C-term amidated
DDPKLYDKDLGSAMTDTVVGWVDAAWSL

SEQ ID NO: 3386 - protein, 28 aa, Artificial Sequence
  Description of Artificial Sequence: Synthetic peptide
DDPKLYDKDLGSAMTDTVVGWVDAAWSL

SEQ ID NO: 3387 - protein, 28 aa, Artificial Sequence
  Description of Artificial Sequence: Synthetic peptide
  C-term amidated
DDPKLYDKDLGSAMTDTVVGWVDAATSL

SEQ ID NO: 3388 - protein, 28 aa, Artificial Sequence
  Description of Artificial Sequence: Synthetic peptide
DDPKLYDKDLGSAMTDTVVGWVDAATSL

SEQ ID NO: 3389 - protein, 28 aa, Artificial Sequence
  Description of Artificial Sequence: Synthetic peptide
  C-term amidated
DDPKLYDKDLGSAMTDTVVGWLDAAWSL

SEQ ID NO: 3390 - protein, 28 aa, Artificial Sequence
  Description of Artificial Sequence: Synthetic peptide
DDPKLYDKDLGSAMTDTVVGWLDAAWSL

SEQ ID NO: 3391 - protein, 28 aa, Artificial Sequence
  Description of Artificial Sequence: Synthetic peptide
  C-term amidated
DDPKLYDKDLGSAMTDTVVGWLDAATSL

SEQ ID NO: 3392 - protein, 28 aa, Artificial Sequence
  Description of Artificial Sequence: Synthetic peptide
DDPKLYDKDLGSAMTDTVVGWLDAATSL

SEQ ID NO: 3393 - protein, 28 aa, Artificial Sequence
  Description of Artificial Sequence: Synthetic peptide
  C-term amidated
DDPKLYDKDLGSAMTDTVVGWMDAAWSL

SEQ ID NO: 3394 - protein, 28 aa, Artificial Sequence
  Description of Artificial Sequence: Synthetic peptide
DDPKLYDKDLGSAMTDTVVGWMDAAWSL

SEQ ID NO: 3395 - protein, 28 aa, Artificial Sequence
  Description of Artificial Sequence: Synthetic peptide
  C-term amidated
DDPKLYDKDLGSAMTDTVVGWMDAATSL

SEQ ID NO: 3396 - protein, 28 aa, Artificial Sequence
  Description of Artificial Sequence: Synthetic peptide
DDPKLYDKDLGSAMTDTVVGWMDAATSL

SEQ ID NO: 3397 - protein, 28 aa, Artificial Sequence
  Description of Artificial Sequence: Synthetic peptide
  C-term amidated
DDPKLYDKDLGSAMTDTVVGQVDAAWSL

SEQ ID NO: 3398 - protein, 28 aa, Artificial Sequence
  Description of Artificial Sequence: Synthetic peptide
DDPKLYDKDLGSAMTDTVVGQVDAAWSL

SEQ ID NO: 3399 - protein, 28 aa, Artificial Sequence
  Description of Artificial Sequence: Synthetic peptide
  C-term amidated
DDPKLYDKDLGSAMTDTVVGQVDAATSL

SEQ ID NO: 3400 - protein, 28 aa, Artificial Sequence
  Description of Artificial Sequence: Synthetic peptide
DDPKLYDKDLGSAMTDTVVGQVDAATSL

SEQ ID NO: 3401 - protein, 28 aa, Artificial Sequence
  Description of Artificial Sequence: Synthetic peptide
  C-term amidated
DDPKLYDKDLGSAMTDTVVGQLDAAWSL

SEQ ID NO: 3402 - protein, 28 aa, Artificial Sequence
  Description of Artificial Sequence: Synthetic peptide
DDPKLYDKDLGSAMTDTVVGQLDAAWSL

SEQ ID NO: 3403 - protein, 28 aa, Artificial Sequence
  Description of Artificial Sequence: Synthetic peptide
  C-term amidated
DDPKLYDKDLGSAMTDTVVGQLDAATSL

SEQ ID NO: 3404 - protein, 28 aa, Artificial Sequence
  Description of Artificial Sequence: Synthetic peptide
DDPKLYDKDLGSAMTDTVVGQLDAATSL

SEQ ID NO: 3405 - protein, 28 aa, Artificial Sequence
  Description of Artificial Sequence: Synthetic peptide
  C-term amidated
DDPKLYDKDLGSAMTDTVVGQMDAAWSL

SEQ ID NO: 3406 - protein, 28 aa, Artificial Sequence
  Description of Artificial Sequence: Synthetic peptide
DDPKLYDKDLGSAMTDTVVGQMDAAWSL

SEQ ID NO: 3407 - protein, 28 aa, Artificial Sequence
  Description of Artificial Sequence: Synthetic peptide
  C-term amidated
DDPKLYDKDLGSAMTDTVVGQMDAATSL

SEQ ID NO: 3408 - protein, 28 aa, Artificial Sequence
  Description of Artificial Sequence: Synthetic peptide
DDPKLYDKDLGSAMTDTVVGQMDAATSL

SEQ ID NO: 3409 - protein, 28 aa, Artificial Sequence
  Description of Artificial Sequence: Synthetic peptide
  C-term amidated
DDPKLYDKDLGSAMGDWVVAWVDAAWSL

SEQ ID NO: 3410 - protein, 28 aa, Artificial Sequence
  Description of Artificial Sequence: Synthetic peptide
DDPKLYDKDLGSAMGDWVVAWVDAAWSL

SEQ ID NO: 3411 - protein, 28 aa, Artificial Sequence
  Description of Artificial Sequence: Synthetic peptide
  C-term amidated
DDPKLYDKDLGSAMGDWVVAWVDAATSL

SEQ ID NO: 3412 - protein, 28 aa, Artificial Sequence
  Description of Artificial Sequence: Synthetic peptide
DDPKLYDKDLGSAMGDWVVAWVDAATSL

SEQ ID NO: 3413 - protein, 28 aa, Artificial Sequence
  Description of Artificial Sequence: Synthetic peptide
  C-term amidated
DDPKLYDKDLGSAMGDWVVAWLDAAWSL

SEQ ID NO: 3414 - protein, 28 aa, Artificial Sequence
  Description of Artificial Sequence: Synthetic peptide
DDPKLYDKDLGSAMGDWVVAWLDAAWSL

SEQ ID NO: 3415 - protein, 28 aa, Artificial Sequence
  Description of Artificial Sequence: Synthetic peptide
  C-term amidated
DDPKLYDKDLGSAMGDWVVAWLDAATSL

SEQ ID NO: 3416 - protein, 28 aa, Artificial Sequence
  Description of Artificial Sequence: Synthetic peptide
DDPKLYDKDLGSAMGDWVVAWLDAATSL

SEQ ID NO: 3417 - protein, 28 aa, Artificial Sequence
  Description of Artificial Sequence: Synthetic peptide
  C-term amidated
DDPKLYDKDLGSAMGDWVVAWMDAAWSL

SEQ ID NO: 3418 - protein, 28 aa, Artificial Sequence
  Description of Artificial Sequence: Synthetic peptide
DDPKLYDKDLGSAMGDWVVAWMDAAWSL

SEQ ID NO: 3419 - protein, 28 aa, Artificial Sequence
  Description of Artificial Sequence: Synthetic peptide
  C-term amidated
DDPKLYDKDLGSAMGDWVVAWMDAATSL

SEQ ID NO: 3420 - protein, 28 aa, Artificial Sequence
  Description of Artificial Sequence: Synthetic peptide
DDPKLYDKDLGSAMGDWVVAWMDAATSL

SEQ ID NO: 3421 - protein, 28 aa, Artificial Sequence
  Description of Artificial Sequence: Synthetic peptide
  C-term amidated
DDPKLYDKDLGSAMGDWVVAQVDAAWSL

SEQ ID NO: 3422 - protein, 28 aa, Artificial Sequence
  Description of Artificial Sequence: Synthetic peptide
DDPKLYDKDLGSAMGDWVVAQVDAAWSL

SEQ ID NO: 3423 - protein, 28 aa, Artificial Sequence
  Description of Artificial Sequence: Synthetic peptide
  C-term amidated
DDPKLYDKDLGSAMGDWVVAQVDAATSL

SEQ ID NO: 3424 - protein, 28 aa, Artificial Sequence
  Description of Artificial Sequence: Synthetic peptide
DDPKLYDKDLGSAMGDWVVAQVDAATSL

SEQ ID NO: 3425 - protein, 28 aa, Artificial Sequence
  Description of Artificial Sequence: Synthetic peptide
  C-term amidated
DDPKLYDKDLGSAMGDWVVAQLDAAWSL

SEQ ID NO: 3426 - protein, 28 aa, Artificial Sequence
  Description of Artificial Sequence: Synthetic peptide
DDPKLYDKDLGSAMGDWVVAQLDAAWSL

SEQ ID NO: 3427 - protein, 28 aa, Artificial Sequence
  Description of Artificial Sequence: Synthetic peptide
  C-term amidated
DDPKLYDKDLGSAMGDWVVAQLDAATSL

SEQ ID NO: 3428 - protein, 28 aa, Artificial Sequence
  Description of Artificial Sequence: Synthetic peptide
DDPKLYDKDLGSAMGDWVVAQLDAATSL

SEQ ID NO: 3429 - protein, 28 aa, Artificial Sequence
  Description of Artificial Sequence: Synthetic peptide
  C-term amidated
DDPKLYDKDLGSAMGDWVVAQMDAAWSL

SEQ ID NO: 3430 - protein, 28 aa, Artificial Sequence
  Description of Artificial Sequence: Synthetic peptide
DDPKLYDKDLGSAMGDWVVAQMDAAWSL

SEQ ID NO: 3431 - protein, 28 aa, Artificial Sequence
  Description of Artificial Sequence: Synthetic peptide
  C-term amidated
DDPKLYDKDLGSAMGDWVVAQMDAATSL

SEQ ID NO: 3432 - protein, 28 aa, Artificial Sequence
  Description of Artificial Sequence: Synthetic peptide
DDPKLYDKDLGSAMGDWVVAQMDAATSL

SEQ ID NO: 3433 - protein, 28 aa, Artificial Sequence
  Description of Artificial Sequence: Synthetic peptide
  C-term amidated
DDPKLYDKDLGSAMGDWVVGWVDAAWSL

SEQ ID NO: 3434 - protein, 28 aa, Artificial Sequence
  Description of Artificial Sequence: Synthetic peptide
DDPKLYDKDLGSAMGDWVVGWVDAAWSL

SEQ ID NO: 3435 - protein, 28 aa, Artificial Sequence
  Description of Artificial Sequence: Synthetic peptide
  C-term amidated
DDPKLYDKDLGSAMGDWVVGWVDAATSL

SEQ ID NO: 3436 - protein, 28 aa, Artificial Sequence
  Description of Artificial Sequence: Synthetic peptide
DDPKLYDKDLGSAMGDWVVGWVDAATSL

SEQ ID NO: 3437 - protein, 28 aa, Artificial Sequence
  Description of Artificial Sequence: Synthetic peptide
  C-term amidated
DDPKLYDKDLGSAMGDWVVGWLDAAWSL

SEQ ID NO: 3438 - protein, 28 aa, Artificial Sequence
  Description of Artificial Sequence: Synthetic peptide
DDPKLYDKDLGSAMGDWVVGWLDAAWSL

SEQ ID NO: 3439 - protein, 28 aa, Artificial Sequence
  Description of Artificial Sequence: Synthetic peptide
  C-term amidated
DDPKLYDKDLGSAMGDWVVGWLDAATSL

SEQ ID NO: 3440 - protein, 28 aa, Artificial Sequence
  Description of Artificial Sequence: Synthetic peptide
DDPKLYDKDLGSAMGDWVVGWLDAATSL

SEQ ID NO: 3441 - protein, 28 aa, Artificial Sequence
  Description of Artificial Sequence: Synthetic peptide
  C-term amidated
DDPKLYDKDLGSAMGDWVVGWMDAAWSL

SEQ ID NO: 3442 - protein, 28 aa, Artificial Sequence
  Description of Artificial Sequence: Synthetic peptide
DDPKLYDKDLGSAMGDWVVGWMDAAWSL

SEQ ID NO: 3443 - protein, 28 aa, Artificial Sequence
  Description of Artificial Sequence: Synthetic peptide
  C-term amidated
DDPKLYDKDLGSAMGDWVVGWMDAATSL

SEQ ID NO: 3444 - protein, 28 aa, Artificial Sequence
  Description of Artificial Sequence: Synthetic peptide
DDPKLYDKDLGSAMGDWVVGWMDAATSL

SEQ ID NO: 3445 - protein, 28 aa, Artificial Sequence
  Description of Artificial Sequence: Synthetic peptide
  C-term amidated
DDPKLYDKDLGSAMGDWVVGQVDAAWSL

SEQ ID NO: 3446 - protein, 28 aa, Artificial Sequence
  Description of Artificial Sequence: Synthetic peptide
DDPKLYDKDLGSAMGDWVVGQVDAAWSL

SEQ ID NO: 3447 - protein, 28 aa, Artificial Sequence
  Description of Artificial Sequence: Synthetic peptide
  C-term amidated
DDPKLYDKDLGSAMGDWVVGQVDAATSL

SEQ ID NO: 3448 - protein, 28 aa, Artificial Sequence
  Description of Artificial Sequence: Synthetic peptide
DDPKLYDKDLGSAMGDWVVGQVDAATSL

SEQ ID NO: 3449 - protein, 28 aa, Artificial Sequence
  Description of Artificial Sequence: Synthetic peptide
  C-term amidated
DDPKLYDKDLGSAMGDWVVGQLDAAWSL

SEQ ID NO: 3450 - protein, 28 aa, Artificial Sequence
  Description of Artificial Sequence: Synthetic peptide
DDPKLYDKDLGSAMGDWVVGQLDAAWSL

SEQ ID NO: 3451 - protein, 28 aa, Artificial Sequence
  Description of Artificial Sequence: Synthetic peptide
  C-term amidated
DDPKLYDKDLGSAMGDWVVGQLDAATSL

SEQ ID NO: 3452 - protein, 28 aa, Artificial Sequence
  Description of Artificial Sequence: Synthetic peptide
DDPKLYDKDLGSAMGDWVVGQLDAATSL

SEQ ID NO: 3453 - protein, 28 aa, Artificial Sequence
  Description of Artificial Sequence: Synthetic peptide
  C-term amidated
DDPKLYDKDLGSAMGDWVVGQMDAAWSL

SEQ ID NO: 3454 - protein, 28 aa, Artificial Sequence
  Description of Artificial Sequence: Synthetic peptide
DDPKLYDKDLGSAMGDWVVGQMDAAWSL

SEQ ID NO: 3455 - protein, 28 aa, Artificial Sequence
  Description of Artificial Sequence: Synthetic peptide
  C-term amidated
DDPKLYDKDLGSAMGDWVVGQMDAATSL

SEQ ID NO: 3456 - protein, 28 aa, Artificial Sequence
  Description of Artificial Sequence: Synthetic peptide
DDPKLYDKDLGSAMGDWVVGQMDAATSL

SEQ ID NO: 3457 - protein, 28 aa, Artificial Sequence
  Description of Artificial Sequence: Synthetic peptide
  C-term amidated
DDPKLYDKDLGSAMGDTVVAWVDAAWSL

SEQ ID NO: 3458 - protein, 28 aa, Artificial Sequence
  Description of Artificial Sequence: Synthetic peptide
DDPKLYDKDLGSAMGDTVVAWVDAAWSL

SEQ ID NO: 3459 - protein, 28 aa, Artificial Sequence
  Description of Artificial Sequence: Synthetic peptide
  C-term amidated
DDPKLYDKDLGSAMGDTVVAWVDAATSL

SEQ ID NO: 3460 - protein, 28 aa, Artificial Sequence
  Description of Artificial Sequence: Synthetic peptide
DDPKLYDKDLGSAMGDTVVAWVDAATSL

SEQ ID NO: 3461 - protein, 28 aa, Artificial Sequence
  Description of Artificial Sequence: Synthetic peptide
  C-term amidated
DDPKLYDKDLGSAMGDTVVAWLDAAWSL

SEQ ID NO: 3462 - protein, 28 aa, Artificial Sequence
  Description of Artificial Sequence: Synthetic peptide
DDPKLYDKDLGSAMGDTVVAWLDAAWSL

SEQ ID NO: 3463 - protein, 28 aa, Artificial Sequence
  Description of Artificial Sequence: Synthetic peptide
  C-term amidated
DDPKLYDKDLGSAMGDTVVAWLDAATSL

SEQ ID NO: 3464 - protein, 28 aa, Artificial Sequence
  Description of Artificial Sequence: Synthetic peptide
DDPKLYDKDLGSAMGDTVVAWLDAATSL

SEQ ID NO: 3465 - protein, 28 aa, Artificial Sequence
  Description of Artificial Sequence: Synthetic peptide
  C-term amidated
DDPKLYDKDLGSAMGDTVVAWMDAAWSL

SEQ ID NO: 3466 - protein, 28 aa, Artificial Sequence
  Description of Artificial Sequence: Synthetic peptide
DDPKLYDKDLGSAMGDTVVAWMDAAWSL

SEQ ID NO: 3467 - protein, 28 aa, Artificial Sequence
  Description of Artificial Sequence: Synthetic peptide
  C-term amidated
DDPKLYDKDLGSAMGDTVVAWMDAATSL

SEQ ID NO: 3468 - protein, 28 aa, Artificial Sequence
  Description of Artificial Sequence: Synthetic peptide
DDPKLYDKDLGSAMGDTVVAWMDAATSL

SEQ ID NO: 3469 - protein, 28 aa, Artificial Sequence
  Description of Artificial Sequence: Synthetic peptide
  C-term amidated
DDPKLYDKDLGSAMGDTVVAQVDAAWSL

SEQ ID NO: 3470 - protein, 28 aa, Artificial Sequence
  Description of Artificial Sequence: Synthetic peptide
DDPKLYDKDLGSAMGDTVVAQVDAAWSL

SEQ ID NO: 3471 - protein, 28 aa, Artificial Sequence
  Description of Artificial Sequence: Synthetic peptide
  C-term amidated
DDPKLYDKDLGSAMGDTVVAQVDAATSL

SEQ ID NO: 3472 - protein, 28 aa, Artificial Sequence
  Description of Artificial Sequence: Synthetic peptide
DDPKLYDKDLGSAMGDTVVAQVDAATSL

SEQ ID NO: 3473 - protein, 28 aa, Artificial Sequence
  Description of Artificial Sequence: Synthetic peptide
  C-term amidated
DDPKLYDKDLGSAMGDTVVAQLDAAWSL

SEQ ID NO: 3474 - protein, 28 aa, Artificial Sequence
  Description of Artificial Sequence: Synthetic peptide
DDPKLYDKDLGSAMGDTVVAQLDAAWSL

SEQ ID NO: 3475 - protein, 28 aa, Artificial Sequence
  Description of Artificial Sequence: Synthetic peptide
  C-term amidated
DDPKLYDKDLGSAMGDTVVAQLDAATSL

SEQ ID NO: 3476 - protein, 28 aa, Artificial Sequence
  Description of Artificial Sequence: Synthetic peptide
DDPKLYDKDLGSAMGDTVVAQLDAATSL

SEQ ID NO: 3477 - protein, 28 aa, Artificial Sequence
  Description of Artificial Sequence: Synthetic peptide
  C-term amidated
DDPKLYDKDLGSAMGDTVVAQMDAAWSL

SEQ ID NO: 3478 - protein, 28 aa, Artificial Sequence
  Description of Artificial Sequence: Synthetic peptide
DDPKLYDKDLGSAMGDTVVAQMDAAWSL

SEQ ID NO: 3479 - protein, 28 aa, Artificial Sequence
  Description of Artificial Sequence: Synthetic peptide
  C-term amidated
DDPKLYDKDLGSAMGDTVVAQMDAATSL

SEQ ID NO: 3480 - protein, 28 aa, Artificial Sequence
  Description of Artificial Sequence: Synthetic peptide
DDPKLYDKDLGSAMGDTVVAQMDAATSL

SEQ ID NO: 3481 - protein, 28 aa, Artificial Sequence
  Description of Artificial Sequence: Synthetic peptide
  C-term amidated
DDPKLYDKDLGSAMGDTVVGWVDAAWSL

SEQ ID NO: 3482 - protein, 28 aa, Artificial Sequence
  Description of Artificial Sequence: Synthetic peptide
DDPKLYDKDLGSAMGDTVVGWVDAAWSL

SEQ ID NO: 3483 - protein, 28 aa, Artificial Sequence
  Description of Artificial Sequence: Synthetic peptide
  C-term amidated
DDPKLYDKDLGSAMGDTVVGWVDAATSL

SEQ ID NO: 3484 - protein, 28 aa, Artificial Sequence
  Description of Artificial Sequence: Synthetic peptide
DDPKLYDKDLGSAMGDTVVGWVDAATSL

SEQ ID NO: 3485 - protein, 28 aa, Artificial Sequence
  Description of Artificial Sequence: Synthetic peptide
  C-term amidated
DDPKLYDKDLGSAMGDTVVGWLDAAWSL

SEQ ID NO: 3486 - protein, 28 aa, Artificial Sequence
  Description of Artificial Sequence: Synthetic peptide
DDPKLYDKDLGSAMGDTVVGWLDAAWSL

SEQ ID NO: 3487 - protein, 28 aa, Artificial Sequence
  Description of Artificial Sequence: Synthetic peptide
  C-term amidated
DDPKLYDKDLGSAMGDTVVGWLDAATSL

SEQ ID NO: 3488 - protein, 28 aa, Artificial Sequence
  Description of Artificial Sequence: Synthetic peptide
DDPKLYDKDLGSAMGDTVVGWLDAATSL

SEQ ID NO: 3489 - protein, 28 aa, Artificial Sequence
  Description of Artificial Sequence: Synthetic peptide
  C-term amidated
DDPKLYDKDLGSAMGDTVVGWMDAAWSL

SEQ ID NO: 3490 - protein, 28 aa, Artificial Sequence
  Description of Artificial Sequence: Synthetic peptide
DDPKLYDKDLGSAMGDTVVGWMDAAWSL

SEQ ID NO: 3491 - protein, 28 aa, Artificial Sequence
  Description of Artificial Sequence: Synthetic peptide
  C-term amidated
DDPKLYDKDLGSAMGDTVVGWMDAATSL

SEQ ID NO: 3492 - protein, 28 aa, Artificial Sequence
  Description of Artificial Sequence: Synthetic peptide
DDPKLYDKDLGSAMGDTVVGWMDAATSL

SEQ ID NO: 3493 - protein, 28 aa, Artificial Sequence
  Description of Artificial Sequence: Synthetic peptide
  C-term amidated
DDPKLYDKDLGSAMGDTVVGQVDAAWSL

SEQ ID NO: 3494 - protein, 28 aa, Artificial Sequence
  Description of Artificial Sequence: Synthetic peptide
DDPKLYDKDLGSAMGDTVVGQVDAAWSL

SEQ ID NO: 3495 - protein, 28 aa, Artificial Sequence
  Description of Artificial Sequence: Synthetic peptide
  C-term amidated
DDPKLYDKDLGSAMGDTVVGQVDAATSL

SEQ ID NO: 3496 - protein, 28 aa, Artificial Sequence
  Description of Artificial Sequence: Synthetic peptide
DDPKLYDKDLGSAMGDTVVGQVDAATSL

SEQ ID NO: 3497 - protein, 28 aa, Artificial Sequence
  Description of Artificial Sequence: Synthetic peptide
  C-term amidated
DDPKLYDKDLGSAMGDTVVGQLDAAWSL

SEQ ID NO: 3498 - protein, 28 aa, Artificial Sequence
  Description of Artificial Sequence: Synthetic peptide
DDPKLYDKDLGSAMGDTVVGQLDAAWSL

SEQ ID NO: 3499 - protein, 28 aa, Artificial Sequence
  Description of Artificial Sequence: Synthetic peptide
  C-term amidated
DDPKLYDKDLGSAMGDTVVGQLDAATSL

SEQ ID NO: 3500 - protein, 28 aa, Artificial Sequence
  Description of Artificial Sequence: Synthetic peptide
DDPKLYDKDLGSAMGDTVVGQLDAATSL

SEQ ID NO: 3501 - protein, 28 aa, Artificial Sequence
  Description of Artificial Sequence: Synthetic peptide
  C-term amidated
DDPKLYDKDLGSAMGDTVVGQMDAAWSL

SEQ ID NO: 3502 - protein, 28 aa, Artificial Sequence
  Description of Artificial Sequence: Synthetic peptide
DDPKLYDKDLGSAMGDTVVGQMDAAWSL

SEQ ID NO: 3503 - protein, 28 aa, Artificial Sequence
  Description of Artificial Sequence: Synthetic peptide
  C-term amidated
DDPKLYDKDLGSAMGDTVVGQMDAATSL

SEQ ID NO: 3504 - protein, 28 aa, Artificial Sequence
  Description of Artificial Sequence: Synthetic peptide
DDPKLYDKDLGSAMGDTVVGQMDAATSL

SEQ ID NO: 3505 - protein, 14 aa, Artificial Sequence
  Description of Artificial Sequence: Synthetic peptide
CTVALPGGYRVRVC

SEQ ID NO: 3506 - protein, 12 aa, Pseudomonas aeruginosa
SGLDKDYLKPDD

SEQ ID NO: 3507 - protein, 28 aa, Artificial Sequence
  Description of Artificial Sequence: Synthetic peptide
LSTAADMQGVVTDGMASGLDKDYLTPGC

SEQ ID NO: 3508 - protein, 28 aa, Artificial Sequence
  Description of Artificial Sequence: Synthetic peptide
LSTAADCQGVVTDGMASGLDKDYLKPDD

SEQ ID NO: 3509 - protein, 28 aa, Artificial Sequence
  Description of Artificial Sequence: Synthetic peptide
LSTAACMQGVVTDGMASGLDKDYLKPDD

SEQ ID NO: 3510 - protein, 28 aa, Artificial Sequence
  Description of Artificial Sequence: Synthetic peptide
LSTACDMQGVVTDGMASGLDKDYLKPDD

SEQ ID NO: 3511 - protein, 28 aa, Artificial Sequence
  Description of Artificial Sequence: Synthetic peptide
LSTAATMQCVVTDGMASGLDKDYLKPDD

SEQ ID NO: 3512 - protein, 28 aa, Artificial Sequence
  Description of Artificial Sequence: Synthetic peptide
LSTAATMQGCVTDGMASGLDKDYLKPDD

SEQ ID NO: 3513 - protein, 28 aa, Artificial Sequence
  Description of Artificial Sequence: Synthetic peptide
LSTAANTQGCVTDGMASGLDKDYLKPDD

SEQ ID NO: 3514 - protein, 28 aa, Artificial Sequence
  Description of Artificial Sequence: Synthetic peptide
LSTAANTQGVCTDGMASGLDKDYLKPDD

SEQ ID NO: 3515 - protein, 28 aa, Artificial Sequence
  Description of Artificial Sequence: Synthetic peptide
LSTAADMTAVCTDGMASGLDKDYLKPDD

SEQ ID NO: 3516 - protein, 28 aa, Artificial Sequence
  Description of Artificial Sequence: Synthetic peptide
LSTAADMTAVVCDGMASGLDKDYLKPDD

SEQ ID NO: 3517 - protein, 28 aa, Artificial Sequence
  Description of Artificial Sequence: Synthetic peptide
LSTAADMQTVVCDGMASGLDKDYLKPDD

SEQ ID NO: 3518 - protein, 28 aa, Artificial Sequence
  Description of Artificial Sequence: Synthetic peptide
LSTAADMQTVVTCGMASGLDKDYLKPDD

SEQ ID NO: 3519 - protein, 28 aa, Artificial Sequence
  Description of Artificial Sequence: Synthetic peptide
LSTAADMQATVTCGMASGLDKDYLKPDD

SEQ ID NO: 3520 - protein, 28 aa, Artificial Sequence
  Description of Artificial Sequence: Synthetic peptide
LSTAADMQATVTDCMASGLDKDYLKPDD

SEQ ID NO: 3521 - protein, 28 aa, Artificial Sequence
  Description of Artificial Sequence: Synthetic peptide
LSTAADMQGVTADCMASGLDKDYLKPDD

SEQ ID NO: 3522 - protein, 28 aa, Artificial Sequence
  Description of Artificial Sequence: Synthetic peptide
LSTAADMQGVTADGCASGLDKDYLKPDD

SEQ ID NO: 3523 - protein, 28 aa, Artificial Sequence
  Description of Artificial Sequence: Synthetic peptide
LSTAADMQGVVTNGCASGLDKDYLKPDD

SEQ ID NO: 3524 - protein, 28 aa, Artificial Sequence
  Description of Artificial Sequence: Synthetic peptide
LSTAADMQGVVTATMGSGLCKDYLKPDD

SEQ ID NO: 3525 - protein, 28 aa, Artificial Sequence
  Description of Artificial Sequence: Synthetic peptide
LSTAADMQGVVTDLTASGLCKDYLKPDD

SEQ ID NO: 3526 - protein, 18 aa, Pseudomonas aeruginosa
VTDGMASGLDKDYLKPDD

SEQ ID NO: 3527 - protein, 8 aa, Artificial Sequence
  Description of Artificial Sequence: Synthetic peptide
RRRRRRRR

SEQ ID NO: 3528 - protein, 6 aa, Artificial Sequence
  Description of Artificial Sequence: Synthetic peptide
VSPPAR

SEQ ID NO: 3529 - protein, 6 aa, Artificial Sequence
  Description of Artificial Sequence: Synthetic peptide
YTPPAL

SEQ ID NO: 3530 - protein, 6 aa, Artificial Sequence
  Description of Artificial Sequence: Synthetic peptide
FSFFAE

SEQ ID NO: 3531 - protein, 6 aa, Artificial Sequence
  Description of Artificial Sequence: Synthetic peptide
SGLDKD

What is claimed is:

1. An isolated peptide consisting of SEQ ID NO: 13 that has one or more modified residue, wherein the modified residues comprises one or more residues that have been enzymatically cyclized, wherein the isolated peptide comprises a thioester bridge in a region from residue position 6 to residue position 16.

2. A pharmaceutical composition, comprising the isolated peptide of claim 1 and a pharmaceutically acceptable carrier.

* * * * *